US012091434B2

United States Patent
Albertini et al.

(10) Patent No.: US 12,091,434 B2
(45) Date of Patent: *Sep. 17, 2024

(54) MUTATED GLYCOPROTEIN OF VESICULAR STOMATITIS VIRUS

(71) Applicants: Centre National de la Recherche Scientifique (CNRS), Paris (FR); Université Paris-Saclay, Gif sur Yvette (FR)

(72) Inventors: Aurélie Albertini, Gometz le Chatel (FR); Yves Gaudin, Paris (FR); Hélène Raux, Antony (FR); Laura Belot, Maurepas (FR); Jovan Nikolic, Paris (FR)

(73) Assignees: Centre National de la Recherche Scientifique (CNRS), Paris (FR); Université Paris-Saclay, Gif Sur Yvette (FR)

( * ) Notice: Subject to any disclaimer, the term of this patent is extended or adjusted under 35 U.S.C. 154(b) by 1092 days.

This patent is subject to a terminal disclaimer.

(21) Appl. No.: 16/649,271

(22) PCT Filed: Sep. 24, 2018

(86) PCT No.: PCT/EP2018/075824
§ 371 (c)(1),
(2) Date: Mar. 20, 2020

(87) PCT Pub. No.: WO2019/057974
PCT Pub. Date: Mar. 28, 2019

(65) Prior Publication Data
US 2020/0216502 A1    Jul. 9, 2020

(30) Foreign Application Priority Data

Sep. 22, 2017 (EP) .................................. 17306255

(51) Int. Cl.
*C07K 14/005* (2006.01)
*C12N 7/00* (2006.01)

(52) U.S. Cl.
CPC .............. *C07K 14/005* (2013.01); *C12N 7/00* (2013.01); *C12N 2760/20222* (2013.01); *C12N 2760/20232* (2013.01); *C12N 2760/20245* (2013.01); *C12N 2760/20262* (2013.01)

(58) Field of Classification Search
None
See application file for complete search history.

(56) References Cited

U.S. PATENT DOCUMENTS

2008/0124357 A1    5/2008    Yao et al.

FOREIGN PATENT DOCUMENTS

WO    01/19380 A2    3/2001

OTHER PUBLICATIONS

Ammayappan et al., Journal of Virology vol. 87 No. 24 p. 13543-13555 (Year: 2013).*
Nikolic, et al., Nat Commun 9, 1029 (Year: 2018).*
Finkelshtein et al., PNAS vol. 110, #18, pp. 7306-7311 (Year: 2013).*
He et al., Can immunotherapy reinforce chemotherapy efficacy? a new perspective on colorectal cancer treatment. Front. Immunol. 14:1237764 (Year: 2023).*
Albertini et al.(2012). Molecular and Cellular Aspects of Rhabdovirus Entry. Viruses 4, 117-139.
Amirache et al. (2014). Mystery solved: VSV-G-LVs do not allow efficient gene transfer into unstimulated T cells, B cells, and HSCs because they lack the LDL receptor. Blood 123, 1422-1424.
Ammayappan et al. (2013). Characteristics of oncolytic vesicular stomatitis virus displaying tumor-targeting ligands. J Virol 87, 13543-13555.
Barber, G.N. (2005). VSV-tumor selective replication and protein translation. Oncogene 24, 7710-7719.
Ferlin et al. (2014). Characterization of pH-sensitive molecular switches that trigger the structural transition of vesicular stomatitis virus glycoprotein from the postfusion state toward the prefusion state. J Virol 88, 13396-13409.
Finkelshtein et al. ( 2013) . L DL receptor and its family members serve as the cellular receptors for vesicular stomatitis virus. Proceedings of the National Academy of Sciences of the United States of America 110, 7306-7311.
Roche et al. (2006). Crystal structure of the low-pH form of the vesicular stomatitis virus glycoprotein G. Science 313, 187-191.
Foche et al. (2007). Structure of the prefusion form of the vesicular stomatitis virus glycoprotein g. Science 315, 843-848.
Nikolic et al. Structural basis for the recognition of LDL-receptor family members by VSV glycoprotein. Nature communications, 9(1), 2018, 1-12.
Messer et al. "Optimizing intracellular antibodies (intrabodies/nanobodies) to treat neurodegenerative disorders" Neurobiology of Disease 134 (2020) 104619.

* cited by examiner

*Primary Examiner* — Shanon A. Foley
*Assistant Examiner* — Myron G Hill
(74) *Attorney, Agent, or Firm* — Banner & Witcoff, Ltd.

(57) ABSTRACT

The invention relates to an isolated non-naturally occurring protein comprising the amino acid sequence as set forth in SEQ ID NO: 1, and wherein the amino acid in position 8, 47, 209 and/or 354 is substituted by any amino acid different from the amino acid indicated at that position in said sequence SEQ ID NO: 1.

15 Claims, 11 Drawing Sheets
Specification includes a Sequence Listing.

Fig. 16

MUTATED GLYCOPROTEIN OF VESICULAR STOMATITIS VIRUS

RELATED APPLICATION DATA

This application is a National Stage Application under 35 U.S.C. 371 of co-pending PCT application number PCT/EP2018/075824 designating the United States and filed Sep. 24, 2018; which claims the benefit of EP application number 17306255.5 and filed Sep. 22, 2017 each of which are hereby incorporated by reference in their entireties.

The invention relates to a mutated viral protein, in particular a muted protein originating from an oncolytic virus.

Vesicular stomatitis virus (VSV) is an enveloped, negative-strand RNA virus that belongs to the Vesiculovirus genus of the Rhabdovirus family. It is an arbovirus which can infect insects, cattle, horses and pigs. In mammals, its ability to infect and kill tumor cells while sparing normal cells makes it a promising oncolytic virus for the treatment of cancer (Barber, 2005; Fernandez et al., 2002; Hastie et al., 2013).

VSV genome encodes five structural proteins among which a single transmembrane glycoprotein (G). The glycoprotein is a classic type I membrane glycoprotein with an amino-terminal signal peptide, an ectodomain of about 450 amino acids, a single alpha helical transmembrane segment and a small intraviral carboxy-terminal domain. The signal peptide is cleaved in the lumen of the endoplasmic reticulum and the native glycoprotein consists in the ectodomain, the transmembrane domain and the intraviral domain.

G plays a critical role during the initial steps of virus infection (Albertini et al., 2012b). First, it is responsible for virus attachment to specific receptors. After binding, virions enter the cell by a clathrin-mediated endocytic pathway. In the acidic environment of the endocytic vesicle, G triggers the fusion between the viral and endosomal membranes, which releases the genome in the cytosol for the subsequent steps of infection. Fusion is catalyzed by a low-pH-induced large structural transition from a pre-toward a post-fusion conformation which are both trimeric (Roche et al., 2006; Roche et al., 2007).

The polypeptide chain of G ectodomain folds into three distinct domains which are the fusion domain (FD), the pleckstrin homology domain (PHD), and the trimerization domain (TrD). During the structural transition, the FD, the PHD and the TrD retain their tertiary structure. Nevertheless, they undergo large rearrangements in their relative orientation due to secondary changes in hinge segments (S1 to S5) which refold during the low-pH induced conformational change (Roche et al., 2006; Roche et al., 2007).

Recently, it has been shown that low-density lipoprotein receptor (LDL-R) and other members of this receptor family serve as VSV receptors (Finkelshtein et al., 2013).

The LDL-R is a type I transmembrane protein which regulates cholesterol homeostasis in mammalian cells (Brown and Goldstein, 1986). LDL-R removes cholesterol carrying lipoproteins from plasma circulation. Ligands bound extracellularly by LDL-R at neutral pH are internalized and then released in the acidic environment of the endosomes leading to their subsequent lysosomal degradation. The receptor then recycles back to the cell surface. LDL-R ectodomain is composed of a ligand-binding domain, an epidermal growth factor (EGF) precursor homology domain and a C-terminal domain enriched in 0-linked oligosaccharides. The ligand binding domain is made of 7 cysteine-rich repeats (CR1 to CR7, FIG. 1). Each repeat is made of approximately 40 amino acids and contains 6 cysteine residues, engaged in 3 disulfide bridges, and an acidic residues cluster that coordinates a $Ca^{2+}$ ion. The intracellular release of the cargo is driven by a low-pH-induced conformational change of LDL-R from an open to a closed conformation.

The LDL-R gene family consists of trans-membrane receptors that reside on the cell-surface, are involved in endocytic uptake of lipoproteins, and require $Ca^{2+}$ for ligand binding. All these receptors have in common several CR repeats (up to several tens), EGF precursor-like repeats, a membrane-spanning region and an intracellular domain containing at least one internalization signal sequence. They are found ubiquitously in all animals including insects.

VSV-G has been widely used for pseudotyping other viruses and VSV-G-pseudotyped lentiviruses (VSV-G-LVs) exhibit the same broad tropism as VSV.

On the other hand, VSV-G-LVs do not allow efficient gene transfer into unstimulated T cells, B cells, and hematopoietic stem cells, as they have a very low expression level of LDL-R (Amirache et al., 2014).

The broad tropism of VSV and VSV-G LVs, due to the ubiquitous distribution of the LDL-R receptor family members, is a limitation of their therapeutic use. This is particularly the case in oncotherapy when one wants to target specifically tumor cells.

One aim of the invention is to obviate this drawback.

One aim of the invention is to provide a new mutated VSV-G protein deficient in one of its properties in order to specifically target this protein.

Another aim of the invention is to provide a new VSV expressing such a protein and its use in oncotherapy.

The invention relates to an isolated non-naturally occurring protein comprising, consisting essentially of or consisting of the amino acid sequence as set forth in SEQ ID NO: 1, which corresponds to (which is) the amino acid sequence of the ectodomain of VSV Indiana strain, wherein at least one of the amino acids at positions 8, 47, 209 and 354, said numbering being made from the position of the first amino acid in the sequence SEQ ID NO:1, is substituted by an amino acid different from the amino acid indicated at that position in said sequence SEQ ID NO: 1, or any homologous protein derived from said protein as set forth in SEQ ID NO:1 by substitution, addition or deletion of at least one amino acid, provided that the derived protein retains at least 70% of identity with the amino acid sequence as set forth in SEQ ID NO: 1, and said derived protein retaining the ability to induce membrane fusion and retaining the ability to interact with LDL membrane receptor, wherein at least one amino acid, of said homologous protein located at a position equivalent to the positions 8, 47, 209 and 354 of said sequence SEQ ID NO: 1, is substituted by an amino acid distinct from the amino acid indicated at that position in the sequence SEQ ID NO:1, said isolated non-naturally occurring protein retaining the ability to induce membrane fusion and being unable to interact with LDL membrane receptor.

In a preferred embodiment, the amino acid at position 8 in SEQ ID NO: 1 of the isolated non-naturally occurring protein of invention (said numbering being made from the position of the first amino acid in the sequence SEQ ID NO: 1), or at the position equivalent in the homologous protein derived from said protein as set forth in SEQ ID NO:1 of the invention, cannot be a Y residue.

In a preferred embodiment, the amino acid at position 209 in SEQ ID NO: 1 of the isolated non-naturally occurring protein of invention (said numbering being made from the position of the first amino acid in the sequence SEQ ID NO: 1), or at the position equivalent in the homologous protein derived from said protein as set forth in SEQ ID NO:1 of the invention, cannot be a H residue.

Thus, in other words, the invention relates to an isolated non-naturally occurring protein comprising the amino acid sequence as set forth in SEQ ID NO: 1, which corresponds to (which is) the amino acid sequence of the ectodomain of VSV Indiana strain, wherein at least one of the amino acids at positions 8, 47, 209 and 354, said numbering being made from the position of the first amino acid in the sequence SEQ ID NO: 1, is substituted by an amino acid different from the amino acid indicated at that position in said sequence SEQ ID NO: 1, wherein the substitution at position 8 is by any amino acid different from the amino acid indicated at that position in said sequence SEQ ID NO: 1, except Y, and wherein the substitution at position 209 is by any amino acid different from the amino acid indicated at that position in said sequence SEQ ID NO: 1, except H, or any homologous protein derived from said protein as set forth in SEQ ID NO: 1 by substitution, addition or deletion of at least one amino acid, provided that the derived protein retains at least 70% of identity with the amino acid sequence as set forth in SEQ ID NO: 1, and said derived protein retaining the ability to induce membrane fusion and retaining the ability to interact with LDL membrane receptor, wherein at least one amino acid, of said homologous protein located at a position equivalent to the positions 8, 47, 209 and 354 of said sequence SEQ ID NO: 1, is substituted by an amino acid distinct from the amino acid indicated at that position in the sequence SEQ ID N° 1, wherein the substitution of the amino acid located at a position equivalent to the position 8 is by any amino acid distinct from the amino acid indicated at that position in the sequence SEQ ID N° 1, except Y, and wherein the substitution of the amino acid located at a position equivalent to the position 209 is by any amino acid distinct from the amino acid indicated at that position in the sequence SEQ ID N° 1, except H, said isolated non-naturally occurring protein retaining the ability to induce membrane fusion and being unable to interact with LDL membrane receptor.

Advantageously, the invention relates to an isolated non-naturally occurring protein comprising, consisting essentially of or consisting of the amino acid sequence as set forth in SEQ ID NO: 1, which corresponds to (which is) the amino acid sequence of the ectodomain of VSV Indiana strain, wherein the amino acid at position 8, or at position 47, or at position 209, or at position 354, or at both positions 8 and 47, or at both positions 8 and 209, or at both positions 8 and 354, or at both positions 47 and 209, or at both positions 47 and 354, or at both positions 209 and 354, or at the positions 8 and 47 and 209, or at the positions 8 and 47 and 354, or at the positions 8 and 209 and 354, or at the positions 47 and 209 and 354, or at the position 8 and 47 and 209 and 354, said numbering being made from the position of the first amino acid in the sequence SEQ ID NO:1, are substituted by any amino acid different from the amino acid found in SEQ ID NO: 1, or any homologous protein derived from said protein as set forth in SEQ ID NO:1 by substitution, addition or deletion of at least one amino acid, provided that the derived protein retains at least 70% of identity with the amino acid sequence as set forth in SEQ ID NO: 1, and said derived protein retaining the ability to induce membrane fusion and retaining the ability to interact with LDL membrane receptor, wherein the amino acid, of said homologous protein, located at a position equivalent to position 8, or to position 47, or to position 209, or to position 354, or to both positions 8 and 47, or to both positions 8 and 209, or to both positions 8 and 354, or to both positions 47 and 209, or to both positions 47 and 354, or to both positions 209 and 354, or to the positions 8 and 47 and 209, or to the positions 8 and 47 and 354, or at the positions 8 and 209 and 354, or to the positions 47 and 209 and 354, or to the position 8 and 47 and 209 and 354, are substituted by any amino acid different from the amino acid found in SEQ ID NO: 1, in particular the amino acid at position 8 is substituted by any amino acid except H, and preferably except Y, the amino acid at position 47 is substituted by any amino acid except K, the amino acid at position 209 is substituted by any amino acid except Y and preferably except H, the amino acid at position 354 is substituted by any amino acid except R, the numbering being made from the position of the first amino acid in the sequence SEQ ID NO: 1, said isolated non-naturally occurring protein retaining the ability to induce membrane fusion and being unable to interact with LDL membrane receptor.

Advantageously, the invention relates to an isolated non-naturally occurring protein comprising or consisting essentially of or consisting of the amino acid sequence as set forth in SEQ ID NO: 1,

KFTIVFPHNQKGNWKNVPSNYHYCPSSSDLNWHNDLIGTAIQVKMPKSHKAIQADGW

MCHASKWVTTCDFRWYGPKYITQSIRSFTPSVEQCKESIEQTKQGTWLNPGFPPQSC

GYATVIDAEAVIVQVLPHHVLVDEYTGHWVDSQFINGKCSNYICPTVHNSTIWHSDY

KVKGLQDSNLISMDITFFSEDGELSSLGKEGTGFRSNYFAYETGGKACKMQYCKHWGV

RLPSGVWFEMADKDLFAAARFPECPEGSSISAPSQTSVDVSLIQDVERILDYSLCQFI

WSKIRAGLPISPVDLSYLAPKNPGTGPAFTIINGTLKYFETRYIRVDIAAPILSRMV

GMISGTTTEREWDDWAPYEDVBIGPNGVLRISSGYKFPLYMIGHGMLDSDLHLSSK

-continued

AQVFEHBHIQDAASQLPDDESLFFGDTGLSKNPIELVEGWFSSWKSSIASFFFILGLI

IGLFLVLRVGIHLCIKLKHTKKRQIYTDIEMNRLGK or any protein derived from said protein as set forth in SEQ ID NO: 1 by substitution, addition or deletion of at least one amino acid, provided that said protein derived protein derived from said protein as set forth in SEQ ID NO: 1 retains the boxed amino acids as shown above, wherein the amino acid at position 8, or at position 47, or at position 209, or at position 354, or at both positions 8 and 47, or at both positions 8 and 209, or at both positions 8 and 354, or at both positions 47 and 209, or at both positions 47 and 354, or at both positions 209 and 354, or at the positions 8 and 47 and 209, or at the positions 8 and 47 and 354, or at the positions 8 and 209 and 354, or at the positions 47 and 209 and 354, or at the position 8 and 47 and 209 and 354, or the corresponding positions in the protein derived from said protein as set forth in SEQ ID NO: 1, are substituted by any amino acid different from the amino acid found in SEQ ID NO: 1, in particular the amino acid at position 8 is substituted by any amino acid except H, and preferably except Y, the amino acid at position 47 is substituted by any amino acid except K, the amino acid at position 209 is substituted by any amino acid except Y and preferably except H, the amino acid at position 354 is substituted by any amino acid except R, the numbering being made from the position of the first amino acid in the sequence SEQ ID NO: 1, said isolated non-naturally occurring protein retaining the ability to induce membrane fusion and is unable to interact with LDL membrane receptor.

Advantageously, the invention relates to an isolated non-naturally occurring protein comprising, consisting essentially of or consisting of the amino acid sequence as set forth in SEQ ID NO: 1, which corresponds to (which is) the amino acid sequence of the ectodomain of VSV Indiana strain, wherein the amino acid at position 47 or at position 354, or at both positions 47 and 354, said numbering being made from the position of the first amino acid in the sequence SEQ ID NO:1, are substituted by any amino acid, in particular by any amino acid except K or R, or any homologous protein derived from said protein as set forth in SEQ ID NO:1 by substitution, addition or deletion of at least one amino acid, provided that the derived protein retains at least 70% of identity with the amino acid sequence as set forth in SEQ ID NO: 1, and said derived protein retaining the ability to induce membrane fusion and retaining the ability to interact with LDL membrane receptor, wherein the amino acid, of said homologous protein, located at a position equivalent to position 47 or to position 354, or to both positions 47 and 354, are substituted by any amino acid, in particular any amino acid except K or R, the numbering being made from the position of the first amino acid in the sequence SEQ ID NO: 1, said isolated non-naturally occurring protein retaining the ability to induce membrane fusion and being unable to interact with LDL membrane receptor.

In one embodiment, said isolated non-naturally occurring protein further comprises a substitution of the amino acid at position 8, or at position 209, or at both positions 8 and 209, by any amino acid, said numbering being made from the position of the first amino acid in the sequence SEQ ID NO:1, preferably wherein the amino acid at position 8 is substituted by any amino acid except H or Y, and preferably wherein the amino acid at position 209 is substituted by any amino acid except H or Y.

Advantageously, the invention relates to an isolated non-naturally occurring protein as defined above comprising, consisting essentially of or consisting of the amino acid sequence as set forth in SEQ ID NO: 1,

KFTLVFPHNQKGNWKNVPSNYHYCPSSSDLNWHNDLIGTAIQVKMPKSHKAIQADGW

MCHASKWVTTCDFRWYGPKYITQSIRSFTPSVEQCKESIEQTKQGTWLNPGFPPQSC

GYATVIDAEAVIVQVTPHHVLVDEYTGHWDSQFINGKCSNYICPTVHNSTIWHSDY

KVKGLQDSNLISMDITFFSEDGELSSLGKEGTGFRSNYEAYETGGKACKMQYCKHWGV

RLPSGVWFEMADKDLFAAARFPECPEGSSISAPSQTSVDVSLIQDVERILDYSLCQET

WSKIRAGLPISPVDLSYLAPKNPGTGPAFTIINGILKYFETRYIRVDIAAPILSRMV

GMISGTTTEREILWDDWAPYEDVETGPNGVLRISSGMKFPLYMIGHGMLDSDLHLSSK

-continued

```
AQVFEHFHIQDAASQLPDDESLFFGDTGLSKNPIELVEGWFSSWKSSIASFFFILGLI

IGLFLVLRVGIHLCIKLKHTKKRQIYTDIEMNRLGK
``` or any protein derived from said protein as set forth in SEQ ID NO: 1 by substitution, addition or deletion of at least one amino acid, provided that said protein derived protein derived from said protein as set forth in SEQ ID NO: 1 retains the boxed amino acids as shown above, wherein the amino acid at position 47 or at position 354, or at both positions 47 and 354, or the corresponding positions in the protein derived from said protein as set forth in SEQ ID NO: 1, are substituted by any amino acid, in particular by any amino acid except K or R, the numbering being made from the position of the first amino acid in the sequence SEQ ID NO: 1, said isolated non-naturally occurring protein retaining the ability to induce membrane fusion and is unable to interact with LDL membrane receptor.

In one embodiment, said isolated non-naturally occurring protein further comprises a substitution of the amino acid at position 8, or at position 209, or at both positions 8 and 209, by any amino acid distinct from the amino acid indicated at that position in the sequence SEQ ID N° 1 or at the position equivalent in said homologous protein, said numbering being made from the position of the first amino acid in the sequence SEQ ID NO:1, preferably wherein the amino acid at position 8 is substituted by any amino acid except H or Y, and preferably wherein the amino acid at position 209 is substituted by any amino acid except H or Y.

The invention is based on the unexpected observation made by the inventors that a substitution of at least one amino acid residues at positions 8, 47, 209 or 354, or the combination of two or three or the four amino acids, affects the ability of VSV G protein to interact with its receptor (LDL membrane receptor) but retain its property to induce membrane fusion, in particular at low pH.

The invention encompasses proteins containing the amino acid sequence SEQ ID NO: 1, which corresponds to the native form of the Indiana strain of VSV, and which lacks the signal peptide. The invention also encompasses any G protein from VSV strains provided that said protein retains the amino acids that are represented with a box in SEQ ID NO: 1.

The G proteins form VSV strains may differ by addition, substitution or insertion of at least one amino acid which are not the amino acid represented with a bow in SEQ ID NO: 1.

Regarding the numbering of the amino acid, this numbering is in the invention conventionally based on the numbering of the amino acids of the native form of the G protein of VSV G Indiana as set forth in SEQ ID NO: 1. The skilled person knows the sequence alignment algorithms and programs (ClustalW for instance) and could easily compare the sequences of different G proteins and recalculate the exact position for a determined G protein compared to the numbering obtain in SEQ ID NO: 1. For sake of clarity, the amino acid at positions 8, 47, 209 and 354 are indicated in bold in the above SEQ ID NO: 1.

The invention encompasses proteins containing the amino acid sequence SEQ ID NO: 1. The invention also encompasses any homologous G protein from VSV strains provided that said protein retains at least 70% of identity with the amino acid sequence SEQ ID NO: 1.

By "at least 70% of identity", it is meant in the invention 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% and 100% of identity with the sequence SEQ ID NO: 1.

Regarding the percentage of identity, it is defined by the percentage of amino acid residues of SEQ ID NO: 1 which align with the same amino acid in the sequence of the homologous protein. The sequence alignment is performed using dedicated algorithms and programs (such as ClustalW, for instance).

Therefore, the protein according to the invention may derive from the following amino acid sequences:

SEQ ID NO: 2, the full length VSV G protein from Indiana strain, by substitution of the amino acids at position 63, or at position 370, or both by any amino acid except K or R, SEQ ID NO: 3, the ectodomain of the VSV G protein from Marraba strain, by substitution of the amino acids at position 47, or at position 354, or both by any amino acid except K or R, SEQ ID NO: 4, the full length VSV G protein from Marraba strain, by substitution of the amino acids at position 63, or at position 370, or both by any amino acid except K or R, SEQ ID NO: 5, the ectodomain of the VSV G protein from New Jersey strain, by substitution of the amino acids at position 47, or at position 358, or both by any amino acid except K or R, SEQ ID NO: 6, the full length VSV G protein from New Jersey strain, by substitution of the amino acids at position 63, or at position 374, or both by any amino acid except K or R, SEQ ID NO: 7, the ectodomain of the VSV G protein from Carajas strain, by substitution of the amino acids at position 47, or at position 358, or both by any amino acid except K or R, SEQ ID NO: 8, the full length VSV G protein from Carajas strain, by substitution of the amino acids at position 63, or at position 374, or both by any amino acid except K or R, SEQ ID NO: 9, the ectodomain of the VSV G protein from Alagoa strain, by substitution of the amino acids at position 47, or at position 354, or both by any amino acid except K or R, SEQ ID NO: 10, the full length VSV G protein from Alagoa strain, by substitution of the amino acids at position 64, or at position 371, or both by any amino acid except K or R, SEQ ID NO: 11, the ectodomain of the VSV G protein from Cocal strain, by substitution of the amino acids at position 47, or at position 354, or both by any amino acid except K or R, and SEQ ID NO: 12, the full length VSV G protein from Cocal strain, by substitution of the amino acids at position 64, or at position 371, or both by any amino acid except K or R.

SEQ ID NO: 13, the ectodomain of the VSV G protein from Morreton strain, by substitution of the amino acids at position 47, or at position 354, or both by any amino acid except K or R, and SEQ ID NO: 14, the full length VSV G protein from Morreton strain, by substitution of the amino acids at position 64, or at position 371, or both by any amino acid except K or R.

Via the crystallographic characterization of the G protein, the inventors showed that residues K47 and R354 are highly critical for the interaction with the LDL derived receptor. When one or both residues are substituted by another amino acid residue have physical and chemical different properties, the resulting G protein loses its capacity to interact with cellular receptor. By contrast, the same resulting protein, in appropriate condition of pH retains its fusogenic property.

In the invention, the protein is isolated, which means that the protein has been isolated from its natural context. The protein is non-naturally occurring, which means that the only way to obtain this protein is to carry out a substitution, in a laboratory, by using technological methods man-made, well known in the art.

More advantageously, the invention relates to the isolated non-naturally occurring protein previously disclosed, wherein said protein comprises, or consists essentially of or consists of one of the following amino acid sequence:

SEQ ID NO: 15-20
SEQ ID NO: 21-26
SEQ ID NO: 27-32
SEQ ID NO: 33-38
SEQ ID NO: 39-44
SEQ ID NO: 45-50, and
SEQ ID NO: 51-56,
  wherein the amino acid at position 47 or at position 354, or at both positions 47 and 354, or the corresponding positions in the protein derived from said protein as set forth in SEQ ID NO: 1, are any amino acid except K or R. In other words, in the invention the amino acids Xaa corresponds to any amino acid except R or K.
SEQ ID NO: 15 corresponds to the ectodomain of the VSV G protein from Indiana strain having a substitution at position 47, by any amino acid except K or R.
SEQ ID NO: 16 corresponds to the ectodomain of the VSV G protein from Indiana strain having a substitution at position 354, by any amino acid except K or R.
SEQ ID NO: 17 corresponds to the ectodomain of the VSV G protein from Indiana strain having a substitution at positions 47 and 354, by any amino acid except K or R.
SEQ ID NO: 18 corresponds to the full length VSV G protein from Indiana strain having a substitution at position 63, by any amino acid except K or R.
SEQ ID NO: 19 corresponds to the full length VSV G protein from Indiana strain having a substitution at position 370, by any amino acid except K or R.
SEQ ID NO: 20 corresponds to the full length VSV G protein from Indiana strain having a substitution at positions 63 and 370, by any amino acid except K or R.
SEQ ID NO: 21 corresponds to the ectodomain of the VSV G protein from Marraba strain having a substitution at position 47, by any amino acid except K or R.
SEQ ID NO: 22 corresponds to the ectodomain of the VSV G protein from Marraba strain having a substitution at position 354, by any amino acid except K or R.
SEQ ID NO: 23 corresponds to the ectodomain of the VSV G protein from Marraba strain having a substitution at positions 47 and 354, by any amino acid except K or R.
SEQ ID NO: 24 corresponds to the full length VSV G protein from Marraba strain having a substitution at position 63, by any amino acid except K or R.
SEQ ID NO: 25 corresponds to the full length VSV G protein from Marraba strain having a substitution at position 370, by any amino acid except K or R.
SEQ ID NO: 26 corresponds to the full length VSV G protein from Marraba strain having a substitution at positions 63 and 370, by any amino acid except K or R.
SEQ ID NO: 27 corresponds to the ectodomain of the VSV G protein from New Jersey strain having a substitution at position 47, by any amino acid except K or R.
SEQ ID NO: 28 corresponds to the ectodomain of the VSV G protein from New Jersey strain having a substitution at position 358, by any amino acid except K or R.
SEQ ID NO: 29 corresponds to the ectodomain of the VSV G protein from New Jersey strain having a substitution at positions 47 and 358, by any amino acid except K or R.
SEQ ID NO: 30 corresponds to the full length VSV G protein from New Jersey strain having a substitution at position 63, by any amino acid except K or R.
SEQ ID NO: 31 corresponds to the full length VSV G protein from New Jersey strain having a substitution at position 374, by any amino acid except K or R.
SEQ ID NO: 32 corresponds to the full length VSV G protein from New Jersey strain having a substitution at positions 63 and 374, by any amino acid except K or R.
SEQ ID NO: 33 corresponds to the ectodomain of the VSV G protein from Carajas strain having a substitution at position 47, by any amino acid except K or R.
SEQ ID NO: 34 corresponds to the ectodomain of the VSV G protein from Carajas strain having a substitution at position 358, by any amino acid except K or R.
SEQ ID NO: 35 corresponds to the ectodomain of the VSV G protein from Carajas strain having a substitution at positions 47 and 358, by any amino acid except K or R.
SEQ ID NO: 36 corresponds to the full length VSV G protein from Carajas strain having a substitution at position 68, by any amino acid except K or R.
SEQ ID NO: 37 corresponds to the full length VSV G protein from Carajas strain having a substitution at position 379, by any amino acid except K or R.
SEQ ID NO: 38 corresponds to the full length VSV G protein from Carajas strain having a substitution at positions 68 and 379, by any amino acid except K or R.
SEQ ID NO: 39 corresponds to the ectodomain of the VSV G protein from Alagoa strain having a substitution at position 47, by any amino acid except K or R.
SEQ ID NO: 40 corresponds to the ectodomain of the VSV G protein from Alagoa strain having a substitution at position 354, by any amino acid except K or R.
SEQ ID NO: 41 corresponds to the ectodomain of the VSV G protein from Alagoa strain having a substitution at positions 47 and 354, by any amino acid except K or R.
SEQ ID NO: 42 corresponds to the full length VSV G protein from Alagoa strain having a substitution at position 64, by any amino acid except K or R.
SEQ ID NO: 43 corresponds to the full length VSV G protein from Alagoa strain having a substitution at position 371, by any amino acid except K or R.
SEQ ID NO: 44 corresponds to the full length VSV G protein from Alagoa strain having a substitution at positions 64 and 371, by any amino acid except K or R.
SEQ ID NO: 45 corresponds to the ectodomain of the VSV G protein from Cocal strain having a substitution at position 47, by any amino acid except K or R.
SEQ ID NO: 46 corresponds to the ectodomain of the VSV G protein from Cocal strain having a substitution at position 354, by any amino acid except K or R.

SEQ ID NO: 47 corresponds to the ectodomain of the VSV G protein from Cocal strain having a substitution at positions 47 and 354, by any amino acid except K or R.

SEQ ID NO: 48 corresponds to the full length VSV G protein from Cocal strain having a substitution at position 64, by any amino acid except K or R.

SEQ ID NO: 49 corresponds to the full length VSV G protein from Cocal strain having a substitution at position 371, by any amino acid except K or R.

SEQ ID NO: 50 corresponds to the full length VSV G protein from Cocal strain having a substitution at positions 64 and 371, by any amino acid except K or R.

SEQ ID NO: 51 corresponds to the ectodomain of the VSV G protein from Morreton strain having a substitution at position 47, by any amino acid except K or R.

SEQ ID NO: 52 corresponds to the ectodomain of the VSV G protein from Morreton strain having a substitution at position 354, by any amino acid except K or R.

SEQ ID NO: 53 corresponds to the ectodomain of the VSV G protein from Morreton strain having a substitution at positions 47 and 354, by any amino acid except K or R.

SEQ ID NO: 54 corresponds to the full length VSV G protein from Morreton strain having a substitution at position 64, by any amino acid except K or R.

SEQ ID NO: 55 corresponds to the full length VSV G protein from Morreton strain having a substitution at position 371, by any amino acid except K or R.

SEQ ID NO: 56 corresponds to the full length VSV G protein from Morreton strain having a substitution at positions 64 and 371, by any amino acid except K or R.

In other word, the invention relates advantageously to an isolated non-naturally occurring protein comprising or consisting of one the following sequences SEQ ID NO: 15-56, wherein Xaa corresponds to any amino acid expect R or K.

Advantageously, the invention relates to the isolated non-naturally occurring protein as defined above, wherein the amino acid at position 47 or at position 354, or at both positions 47 and 354 are substituted by A, G, F or Q, preferably A or Q.

In other word, the invention relates advantageously to an isolated non-naturally occurring protein comprising or consisting of one the following sequences: SEQ ID NO: 15-56, wherein Xaa corresponds to any amino acid expect R or K.

Advantageously, the invention relates to an isolated protein comprising, consisting essentially of, or consisting of one of the following sequences SEQ ID NO: 155-322. In other words, the invention relates advantageously to an isolated protein as defined above comprising, consisting essentially of, or consisting of one of the following sequences SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, SEQ ID NO: 169, SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, SEQ ID NO: 321 and SEQ ID NO: 322.

More advantageously, the invention relates to the isolated non-naturally occurring protein as defined above, wherein the amino acid at position 8 of SEQ ID NO: 1 or the corresponding positions in the protein derived from said protein as set forth in SEQ ID NO: 1, is substituted by any amino acid except H or Q or Y.

More advantageously, the invention relates to the isolated non-naturally occurring protein as defined above, wherein the amino acid at position 209 of SEQ ID NO: 1 or the corresponding positions in the protein derived from said protein as set forth in SEQ ID NO: 1, is substituted by any amino acid except Y or H.

More advantageously, the invention relates to the isolated non-naturally occurring protein as defined above, wherein said protein comprises or consists essentially of one of the following amino acid sequence: SEQ ID NO 57-154.

SEQ ID NO 57-154 represent proteins wherein the amino acid at position 47 or at position 354, or at both positions 47 and 354, or the corresponding positions in the protein derived from said protein as set forth in SEQ ID NO: 1, are substituted by any amino acid except K or R, and wherein the amino acid at position 8 of SEQ ID NO: 1 or the corresponding positions in the protein derived from said protein as set forth in SEQ ID NO: 1, is substituted by any amino acid except H or Q or preferably except Y the amino acid at position 209 of SEQ ID NO: 1 or the corresponding positions in the protein derived from said protein as set forth in SEQ ID NO: 1, is substituted by any amino acid except Y or H, or the amino acid at position 8 of SEQ ID NO: 1 or the corresponding positions in the protein derived from said protein as set forth in SEQ ID NO: 1, is substituted by any amino acid except H or Q or preferably except Y and the amino acid at position 209 of SEQ ID NO: 1 or the corresponding positions in the protein derived from said protein as set forth in SEQ ID NO: 1, is substituted by any amino acid except Y or H.

More advantageously, the invention relates to the isolated non-naturally occurring protein as defined above, further comprising an insertion of a peptide between the amino acids at positions 192 to 202, or
240 to 257, or
347 to 353, or
364 to 366, or
376 to 379, said peptide originating from a protein different from the protein as set forth in SEQ ID NO: 1. The inventors identified that an insertion of a peptide, said peptide originating from a protein different from the G protein of VSV, within the above mentioned region does not alter the fusion property of the protein according to the invention.

In the invention, an insertion "between the amino acids positions 192 to 202, 240 to 257, 347 to 353, 364 to 366, or 376 to 379" means that the peptide is inserted either between two consecutive amino acids, for instance between the amino acids at positions 192 and 193, 193 and 194, 194 and 195, 195 and 196, 196 and 197, 197 and 198, 198 and 199, 199 and 200, 200 and 201, 201 and 202, 240 and 241, 241 and 242, 242 and 243, 243 and 244, 244 and 245, 245 and 246, 246 and 247, 247 and 248, 248 and 249, 249 and 250, 250 and 251, 251 and 252, 252 and 253, 253 and 254, 254 and 255, 255 and 256, 256 and 257, 347 and 348, 348 and 349, 349 and 350, 350 and 351, 351 and 352, 352 and 353, 364 and 365, 365 and 366, 376 and 377, 377 and 378, and 378 and 379, or between two non-consecutive numbered amino acids due to a deletion of one or more amino acid; for instance a peptide can be inserted between the amino acids at positions 192 and 194, because the amino acid at position 193 was deleted or replaced by the inserted peptide (etc.).

With the above explanations, the skilled person will be able to determine the positions of the insertion encompassed by the invention.

More advantageously, the invention relates to the isolated non-naturally occurring protein as defined above, further comprising an insertion of a peptide between the amino acids at position 351 and 352, said peptide originating from a protein different from the protein as set forth in SEQ ID NO: 1. Advantageously, the invention relates to the isolated non-naturally occurring protein as defined above, further comprising an insertion of a peptide in position 1 (in other words, at the N-terminal extremity, i.e. upstream of the amino acid at position 1), said peptide originating from a protein different from the protein as set forth in SEQ ID NO: 1. In the invention, an insertion of a peptide in position 1 means an insertion of said peptide at the N-terminal extremity of the non-naturally occurring protein as defined above. Thus, in this embodiment, the first amino acid residue of the sequence of said non-naturally occurring protein as defined above is preserved (maintained). In other words, said first amino acid residue at position 1 of the sequence of said non-naturally occurring protein as defined above is not deleted. In an alternative embodiment, the invention relates to the isolated non-naturally occurring protein as defined above, further comprising an insertion of a peptide in replacement of the amino acid residue at position 1, said peptide originating from a protein different from the protein as set forth in SEQ ID NO: 1. Thus, in this alternative embodiment, the first amino acid residue of the sequence of said non-naturally occurring protein as defined above is deleted and replaced (i.e. substituted) with the sequence of said peptide.

Advantageously, the inventors identified that an insertion in position 1 (in other words, at the N-terminal extremity) or between the amino acids 351 and 352 of SEQ ID NO: 1, or the corresponding position in SEQ ID NO: 2-14, and having a mutation at the position 47, or 354 or both, or the corresponding position in SEQ ID NO: 2-14 does not modify the fusion properties of the mutated protein.

Therefore, the inventors propose to insert in the VSV G protein enable to interact with its receptor, between these two amino acids, a tag peptide, a luminescent, a nanobody or any peptide that recognize specifically a membrane protein.

In other words, and with a specific advantage, the inventors therefore propose to provide a mutated VSV G protein, in which is inserted, between the two above mentioned amino acids, any peptide that would allow a specific targeting of cells of interest.

More advantageously, the invention relates to the isolated non-naturally occurring protein as defined above, wherein said peptide is at least a part of a ligand of a cellular receptor.

With the mutated protein according to the invention, in which it is inserted a peptide or a nanobody, it become possible to produce a VSV that specifically target a cell of interest, in particular a tumoral cell, and therefore specifically kill this determined cell by using the oncolytic properties of the virus.

Indeed, in this case, the G protein according to the invention would not interact with its natural receptor (LDL-R) but will recognize a receptor which is a target to the peptide inserted between the amino acids at position 351 and 352 of SEQ ID NO: 1, or the corresponding positions in SEQ ID NO: 2-14. As the protein according to the invention retains its fusogenic properties, the protein would allow the virus entry, and the virus could therefore kill the targeted cell.

For instance, the inserted peptide could be an anti-HER2 nanobody, an anti-MUC18 nanobody or an anti-PD-1 nanobody.

The invention also relates to a nucleic acid molecule coding for an isolated non-naturally occurring protein as defined above.

In other words, the invention relates to a nucleic acid molecule coding for any protein as set forth in SEQ ID NO: 15-322, as defined above.

In another aspect, the invention relates to a recombinant virus expressing an isolated non-naturally occurring protein as defined above. An advantageous virus is a VSV expressing all the viral protein in their wild type form except the G protein which corresponds to the mutated protein according to the invention.

Advantageously, the invention relates to a recombinant virus comprising a nucleic acid molecule as defined above.

The invention also relates to a eukaryotic cell containing or expressing a non-naturally occurring protein as defined above, or containing a nucleic acid molecule as defined above. Advantageously, the invention relates to a eukaryotic cell infected by a virus as defined above.

The invention also relates to a composition comprising one at least of the followings:
- a protein according as defined above; or
- a nucleic acid molecule as defined above;
- a virus as defined above; or,
- a eukaryotic cell as defined above.

In particular, the invention relates to a composition comprising a virus coding for a G protein comprising or consisting of one of the following sequences SEQ ID NO: 15-322.

The invention also relates to a composition comprising one at least of the followings:
- a protein according as defined above; or
- a nucleic acid molecule as defined above;
- a virus as defined above; or,
- a eukaryotic cell as defined above,
- for its use as drug.

In particular, the invention relates to a composition comprising a virus coding for a G protein comprising or consisting of one of the following sequences SEQ ID NO: 15-322, for its use as drug.

Advantageously, the invention relates to the composition as defined above, for its use for treating cancer.

As mentioned above, a virus expressing a mutated protein according to the invention can be used to specifically target a determined cell and therefore to specifically kill them.

The invention relates to the in vitro use of a protein as defined above, anchored in surface, advantageously, a lipid membrane for targeting said surface, advantageously a lipid membrane, to a specific target, for instance a cell, in particular a cell to be killed, such as a cancer cell.

In the invention, it is proposed to use in vitro a protein according to the invention which is anchored to a membrane to specifically address such membrane to a target destination. For instance, the mutated protein according to the invention can be anchored in the membrane of a liposome, of a vesicle, of an exosome, on a capsule, on a nanoparticle . . . such that the protein according to the invention can specifically target this liposome, vesicle, capsule or nanoparticle to a specific target, for instance a cell, in particular a cell to be killed, such as a cancer cell.

This use is particularly advantageous in a drug-delivery targeting purpose, wherein the protein according to the invention allow a specific target of a drug.

The drug can be a therapeutic molecule, a protein, and a nucleic acid.

The invention relates to a protein as defined above, anchored in a surface, advantageously, a lipid membrane, for use for targeting said surface, advantageously a lipid membrane, to a specific target, for instance a cell, in particular a cell to be killed, such as a cancer cell.

In the invention, it is proposed a protein according to the invention which is anchored to a membrane for use to specifically address such membrane to a target destination. For instance, the mutated protein according to the invention can be anchored in the membrane of a liposome, of a vesicle, of an exosome, on a capsule, on a nanoparticle . . . such that the protein according to the invention can specifically target this liposome, vesicle, capsule or nanoparticle to a specific target, for instance a cell, in particular a cell to be killed, such as a cancer cell.

This use is particularly advantageous in a drug-delivery targeting purpose, wherein the protein according to the invention allows to specifically target a drug to a specific target, for instance a cell, in particular a cell to be killed, such as a cancer cell.

Thus, the invention relates to a mutated protein according to the invention for use as a drug delivery-system, wherein said mutated protein is anchored in the membrane of a liposome, or of a vesicle, or of an exosome, or on a capsule, or on a nanoparticle.

The drug can be a therapeutic molecule, a protein, and a nucleic acid.

The invention will be better understood from the following figures and examples.

LEGEND TO THE FIGURES

FIG. 1 is a schematic representation of the modular organization of the LDL-R indicating the 7 CR modules (1 to 7), the 3 EGF repeats (a b and c), the seven-bladed β-propeller domain (β) of the epidermal growth factor precursor like domain (B.), and the C-terminal domain containing O-linked oligosaccharides (C.). SP=signal peptide; X=transmembrane domain. A.: CR domains and D.: ectodomain.

FIG. 2 represents a result of a SDS PAGE analysis of interaction experiments between the 7 GST-CR domains (1-7), bounded to GSH magnetic beads, and Gth at pH 8. C. represents control. The migration position of the proteins are indicated by an arrow: A.: Gth, B.: CRx-GST and D.: GST.

FIG. 3 illustrates the experiments presented in FIG. 6 and FIG. 7. After 4 h of infection, BSR cells were labelled with an antibody directed against VSV nucleoprotein (Anti VSV N) to visualize the infection (green fluorescence) and a GST-CRATTO550 to probe CR domain recognition by the surface displayed glycoprotein (red fluorescence).

FIGS. 4A-4I are photographs of labelling of G at the surface of BSR cells infected with VSV using fluorescent GST-CR1ATTO550, GST-CR2ATTO550 and GST-CR3ATTO550. At 4 h post infection, cells were incubated with the appropriate GST-CRATTO550 at 4° C. during 30 minutes prior fixation and permeabilization and then immuno-labelled using an anti-VSV N antibody to visualize the infection. DAPI was used to stain the nuclei. Scale bars 20 μm.

FIG. 4A represents the labelling of cells using anti-VSV N antibody.

FIG. 4B represents the labelling of cells using the fluorescent GST-CR1ATTO550.

FIG. 4C represent the superposition of the fluorescence in FIG. 6A and FIG. 6B.

FIG. 4D represents the labelling of cells using anti-VSV N antibody.

FIG. 4E represents the labelling of cells using the fluorescent GST-CR2ATTO550.

FIG. 4F represent the superposition of the fluorescence in FIG. 6D and FIG. 6E.

FIG. 4G represents the labelling of cells using anti-VSV N antibody.

FIG. 4H represents the labelling of cells using the fluorescent GST-CR3ATTO550.

FIG. 4I represent the superposition of the fluorescence in FIG. 6G and FIG. 6H.

FIG. 5 represents representative plots of each Isothermal titration calorimetry (ITC) analyses between Gth and CR1, Gth and CR2, Gth and CR3 at 20° C. Binding parameters were determined by curve fitting analysis with a single-site binding model. The values indicated in the panel are those corresponding to the curves that are presented. Kd values given in the text are means of 3 independent experiments+/− standard errors. B-C Inhibition of VSV infection by soluble forms of CR domains. Upper x-axis: time (min); upper Y-axis: pcal/s; lower x-axis: molar ratio and lower y-axis: kcal·mol$^{-1}$ of injectant. Left panel: CR1, middle panel: CR2 and right panel: CR3.

FIGS. 6A-6F represents photographs of BSR cells infected with VSV-eGFP preincubated with GST-CR1, GST-CR2, GST-CR3 (A-C), CR1, CR2, or CR3 monovalent domains (D-F) at the indicated concentrations. Cells were fixed 4 h post infection. Only infected cells are expressing eGFP. Neither CR1 nor GST-CR1 construction protect cells from infection. DAPI was used to stain the nuclei. Scale bars 100 μm.

In both complexes the CR domain is nested in the same cavity of G. N- and C-terminal extremities of each CR are indicated. The trimerization domain (TrD) the pleckstrin homology domain (PHD) and the fusion domain (FD) of Gth are represented.

Figure 9:
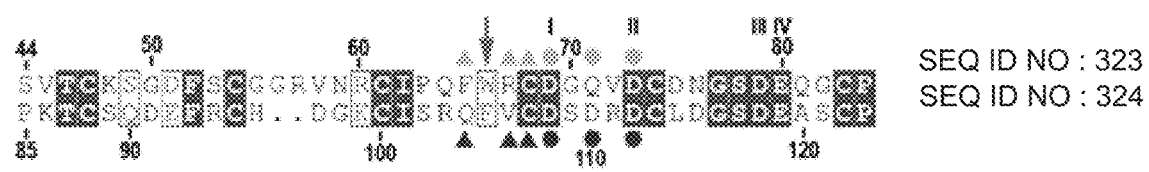
Figure 13A:
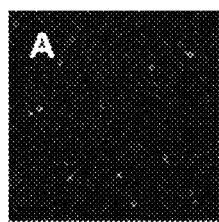
Figure 13B:
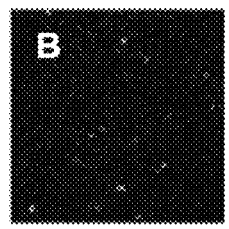
Figure 13C:
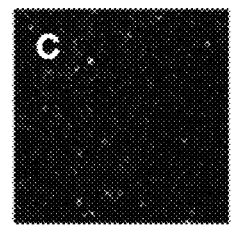
Figure 13D:
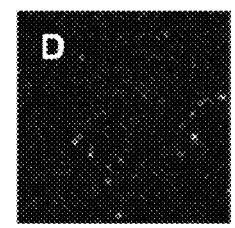
Figure 13E:
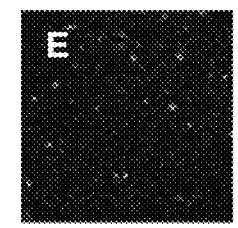
Figure 13F:
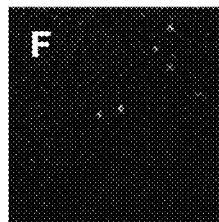

FIG. 9 is a sequence alignment of LDL-R CR2 and CR3. Conserved residues are in a grey box and similar residues are boxed. Acidic residues involved in the binding of the Ca$^{2+}$ ion are indicated by I, II, III, and IV. CR residues involved in polar contacts with G are labelled with grey symbols (light grey for CR2 and black for CR3; dots when the contact is established via the lateral chain and triangles when the contact is established via the main chain) on each CR sequence. The aromatic residue which protrudes from the CR modules and establishes hydrophobic interactions with G is indicated by the arrow.

FIG. 10A corresponds to a close-up view on the Gth-CR interface showing the docking of G basic residues on the acidic patch of CR2. The G residues H8, K47, Y209 and R354 are involved in the interaction. Residues labels on each CR domain are in italic letters when the contact is established via the main chain; putative bonds are shown as light grey dashed lines.

FIG. 10B corresponds to a close-up view on the Gth-CR interface showing the docking of G basic residues on the acidic patch of CR3. The G residues H8, K47, Y209 and R354 are involved in the interaction. Residues labels on each CR domain are in italic letters when the contact is established via the main chain; putative bonds are shown as light grey dashed lines.

FIGS. 11A-11N represent flow cytometry analysis of the expression of WT and mutant glycoproteins at the surface of HEK293T cells and of the binding of fluorescent GST-CR2 (A-D and I-K) and GST-CR3 (E-H and L-M). After 24 h of transfection, cell surface expression of WT and mutant G was assessed using monoclonal anti-G antibody 8G5F11 directly on living cells at 4° C. during 1 h. Cells were then incubated simultaneously with anti-mouse Alexa fluor 488 and the indicated GST-CRATTO550 dye. Cells transfected with a G construct that was still able to bind GST-CR domains exhibited red fluorescence due the ATTO550 dye. In each plot, the percentage of ATTO550 positive cells is indicated.

FIG. 11A represents the experiment of binding of fluorescent GST-CR2 with WT glycoprotein.

FIG. 11B represents the experiment of binding of fluorescent GST-CR2 with the glycoprotein H8A mutant.

FIG. 11C represents the experiment of binding of fluorescent GST-CR2 with the glycoprotein Y209A mutant.

FIG. 11D represents the experiment of binding of fluorescent GST-CR2 with the glycoprotein K47A mutant.

FIG. 11E represents the experiment of binding of fluorescent GST-CR3 with WT glycoprotein.

FIG. 11F represents the experiment of binding of fluorescent GST-CR3 with the glycoprotein H8A mutant.

FIG. 11G represents the experiment of binding of fluorescent GST-CR3 with the glycoprotein Y209A mutant.

FIG. 11H represents the experiment of binding of fluorescent GST-CR3 with the glycoprotein K47A mutant.

FIG. 11I represents the experiment of binding of fluorescent GST-CR2 with the glycoprotein K47Q mutant.

FIG. 11J represents the experiment of binding of fluorescent GST-CR2 with the glycoprotein R354A mutant.

FIG. 11K represents the experiment of binding of fluorescent GST-CR2 with the glycoprotein R354Q mutant.

FIG. 11L represents the experiment of binding of fluorescent GST-CR3 with the glycoprotein K47Q mutant.

FIG. 11M represents the experiment of binding of fluorescent GST-CR3 with the glycoprotein R354A mutant.

FIG. 11N represents the experiment of binding of fluorescent GST-CR3 with the glycoprotein R354Q mutant.

FIG. 12 is a schematic representation of the cell-cell fusion assay. BSR cells are co-transfected with plasmids expressing VSV G (either WT or mutant G) and P-GFP (a cytoplasmic marker). 24 h post-transfection cells are exposed for 10 min to media adjusted to the indicated pH which is then replaced by DMEM at pH 7.4. The cells are then kept at 37° C. for 1 h before fixation. Upon fusion, the P-GFP diffuses in the syncytia.

FIGS. 13A-13X are photographs corresponding to the results of the experiment described in FIG. 12.

FIG. 13A represents the result of experiments with empty vector at pH 5.0.

FIG. 13B represents the result of experiments with empty vector at pH 5.5.

FIG. 13C represents the result of experiments with empty vector at pH 6.0.

FIG. 13D represents the result of experiments with empty vector at pH 6.5.

FIG. 13E represents the result of experiments with empty vector at pH 7.0.

FIG. 13F represents the result of experiments with empty vector at pH 7.5.

Figure 13G:
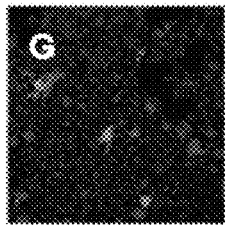

FIG. 13G represents the result of experiments with vector expressing K47A mutant at pH 5.0.

Figure 13H:
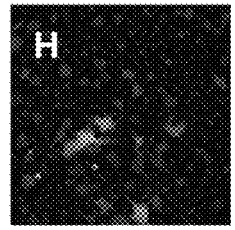

FIG. 13H represents the result of experiments with vector expressing GK47A mutant at pH 5.5.

Figure 13I:
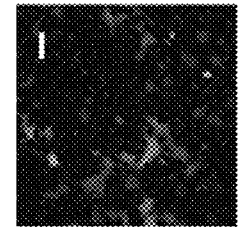

FIG. 13I represents the result of experiments with vector expressing K47A mutant at pH 6.0.

Figure 13J:
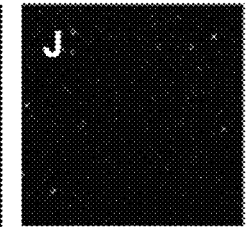

FIG. 13J represents the result of experiments with vector expressing K47A mutant at pH 6.5.

Figure 13K:
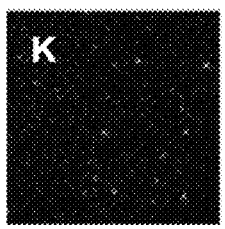

FIG. 13K represents the result of experiments with vector expressing K47A mutant at pH 7.0.

Figure 13L:
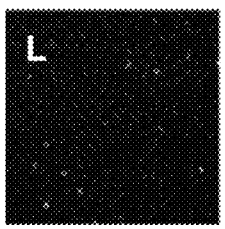

FIG. 13L represents the result of experiments with vector expressing K47A mutant at pH 7.5.

Figure 13M:
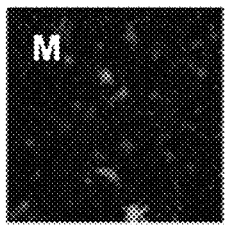

FIG. 13M represents the result of experiments with vector expressing R354A mutant at pH 5.0.

Figure 13N:
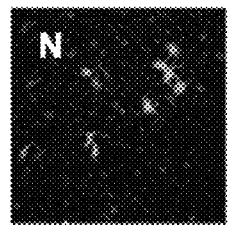

FIG. 13N represents the result of experiments with vector expressing R354A mutant at pH 5.5.

Figure 13O:
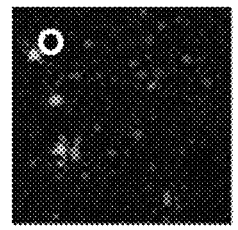

FIG. 13O represents the result of experiments with vector expressing R354A mutant at pH 6.0.

Figure 13P:
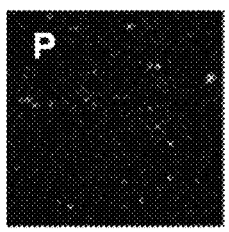

FIG. 13P represents the result of experiments with vector expressing R354A mutant at pH 6.5.

Figure 13Q:
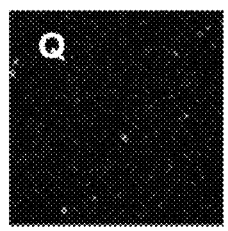

FIG. 13Q represents the result of experiments with vector expressing R354A mutant at pH 7.0.

Figure 13R:
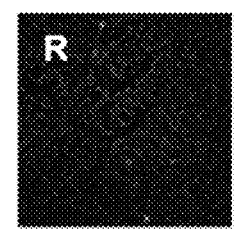

FIG. 13R represents the result of experiments with vector expressing R354A mutant at pH 7.5.

FIG. 13M represents the result of experiments with vector expressing WT G protein at pH 5.0.

FIG. 13N represents the result of experiments with vector expressing WT G protein at pH 5.5.

FIG. 13O represents the result of experiments with vector expressing WT G protein at pH 6.0.

FIG. 13P represents the result of experiments with vector expressing WT G protein at pH 6.5.

FIG. 13Q represents the result of experiments with vector expressing WT G protein at pH 7.0.

FIG. 13R represents the result of experiments with vector expressing WT G protein at pH 7.5.

Figure 13S:
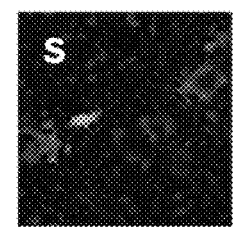

FIG. 13S represents the result of experiments with vector expressing WT G protein at pH .0.

Figure 13T:
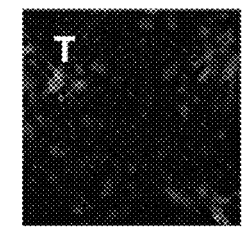

FIG. 13T represents the result of experiments with vector expressing WT G protein at pH 5.5.

Figure 13U:
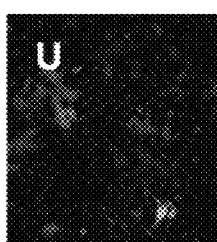

FIG. 13U represents the result of experiments with vector expressing WT G protein at pH 6.0.

Figure 13V:
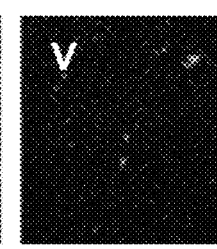

FIG. 13V represents the result of experiments with vector expressing WT G protein at pH .5.

Figure 13W:
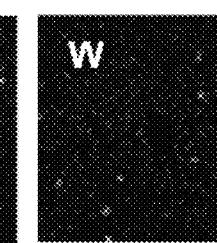

FIG. 13W represents the result of experiments with vector expressing WT G protein at pH 7.0.

Figure 13X:
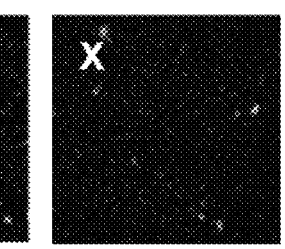

FIG. 13X represents the result of experiments with vector expressing WT G protein at pH 7.5.

Figure 14:
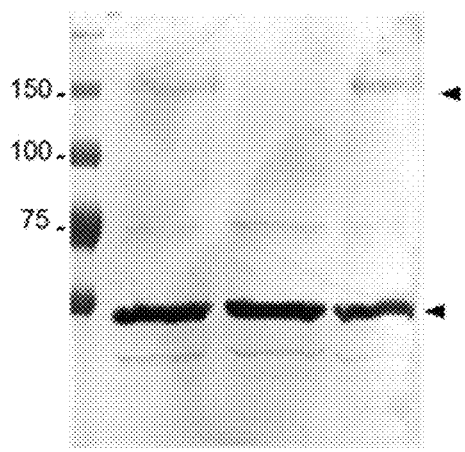

FIG. 14 represent an analysis of LDL-R expression in wild-type HAP-1 cells (A), LDL-RKO HAP-1 (B) cells and HEK293T (C). The immunoblot was performed on crude cell extracts and revealed with anti LDL-R (EP1553Y—1.). Tubulin (tub) was also immunoblotted as a loading control (2.).

Figure 15:
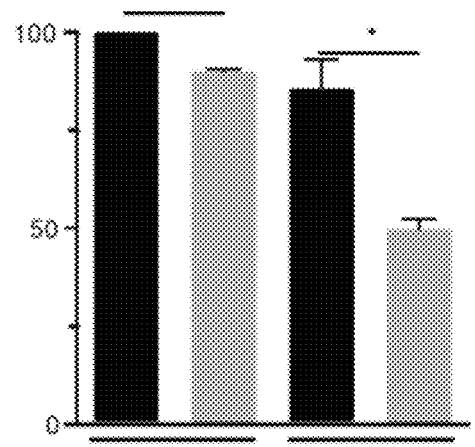

FIG. 15 is an histogram showing the effect of the RAP protein on the susceptibility of LDL-R deficient HAP-1 cells to VSV-eGFP infection. VSV-eGFP was used to infect HAP-1 (A) and HAP-1 LDL-RKO (B) cells in presence of RAP (grey column) or not (black column). Infectivity was determined by counting the number of cells expressing eGFP using a flow cytometer. Data depict the mean with standard error for experiments performed in triplicate. p values were determined using an unpaired Student t test (* p<0.01; *** non-significant).

Figure 16:
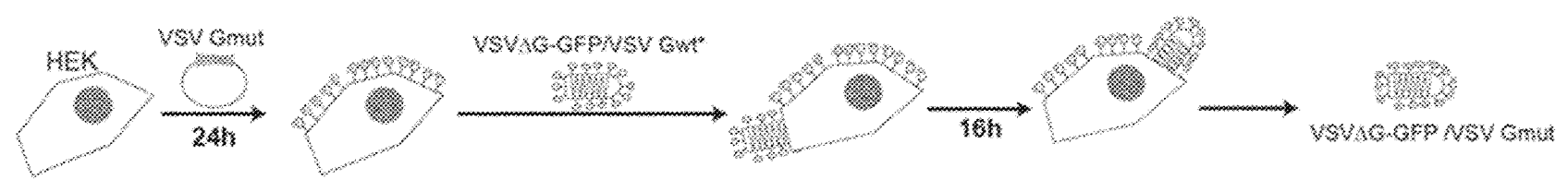

FIG. 16 is a schematic representation of the generation of VSVΔG-GFP virus pseudotyped with VSV G mutants. Transfected HEK-293T cells expressing mutant G at their surface were infected with VSVΔG-GFP pseudotyped with VSV G wild type. After 16 h of infection, VSVΔG-GFP virions pseudotyped with mutant VSV G were harvested from the supernatant.

Figure 17:
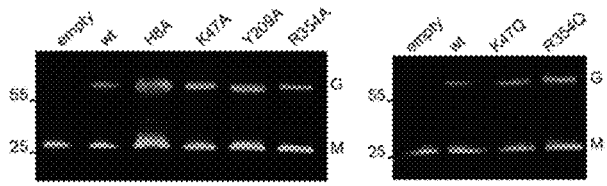

FIG. 17 represents the incorporation of wild type and mutant G in VSVΔG-GFP viral particles. VSVΔG-GFP pseudotyped with the wild type VSV G was used to infect HEK-293T cells transfected with the indicated mutant (MOI 1). At 16 h post infection, viral supernatants were collected, concentrated and analyzed by Western blot (using an anti-VSV G and an anti-VSV M antibody).

Figure 18:
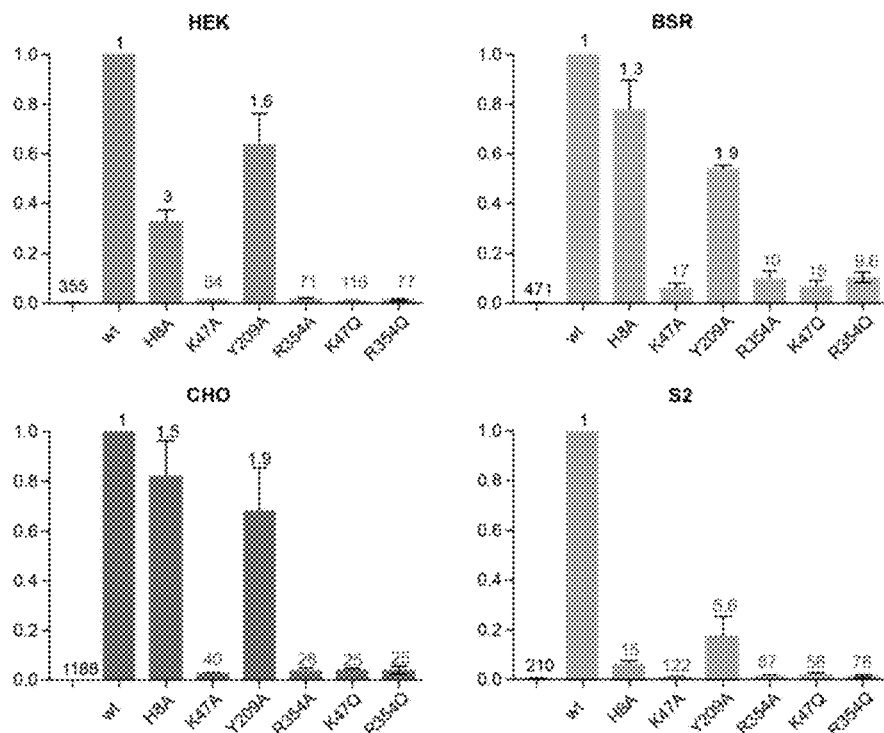

FIG. 18 represents histograms showing the infectivity of VSVΔG-GFP pseudotyped with WT and mutant glycoproteins. VSVΔG-GFP pseudotyped with WT VSV G was used to infect HEK-293T cells previously transfected with the indicated mutated glycoprotein (MOI 1). VSVΔG-GFP viruses pseudotyped by WT or mutant glycoproteins were used to infect HEK-293T, BSR, CHO and S2 cells during 6 h; the percentage of infected cells was determined by counting GFP expressing cells by flow cytometry. Data depict the mean with standard error for three independent experiments. Above each bar, the reduction factor of the titer (compared to VSVΔG-GFP, pseudotyped by WT G which was normalized to 1) is indicated.

Figure 19:
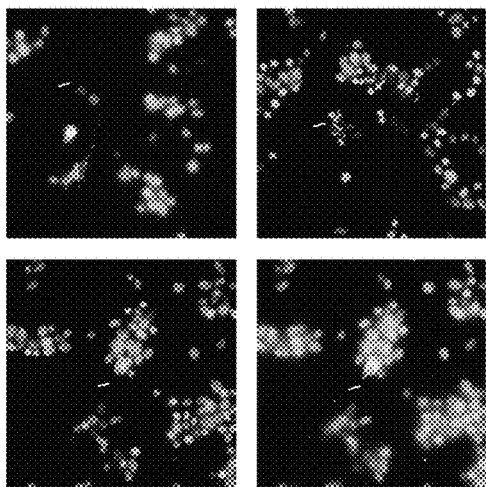

FIG. 19 are photographies of HEK293T cells transfected with a pCAGGS plasmid encoding for VSV glycoprotein modified by the insertion of the mCherry protein in Nter-minal extremity (position 1 of the mature protein) and by the insertion of the mCherry protein in between AA 351 and 352. Red fluorescence is present at the cell surface in both case indicating that the protein was correctly refolded and transported throw the Golgi apparatus. This suggests that those two positions on G are potentially interesting to insert any peptide.

EXAMPLES

Example 1: Structural Basis of Low-Density Lipoprotein Receptor Recognition by VSV Glycoprotein The inventors identified that VSV G is able to independently bind two distinct CR (cysteine-rich) domains (CR2 and CR3) of LDL-R and they report crystal structures of VSV G in complex with those domains. The structures reveal that the binding sites of CR2 and CR3 on G are identical. We show that HAP-1 cells in which the LDL-R gene has been knocked out are still susceptible to VSV infection confirming that VSV G can use receptors other than LDL-R for entry. However, mutations of basic residues, which are key for interaction with LDL-R CR domains, abolish VSV infectivity in mammalian as well as insect cells. This indicates that the only receptors of VSV in mammalian and in insect cells are members of the LDL-R family and that VSV G has specifically evolved to interact with their CR domains.

LDL-R CR2 and CR3 Domains Bind VSV G and Neutralize Viral Infectivity

Figure 1:
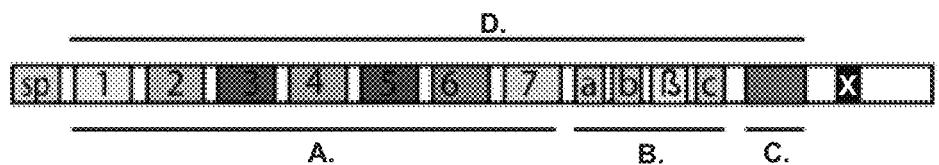
Figure 2:
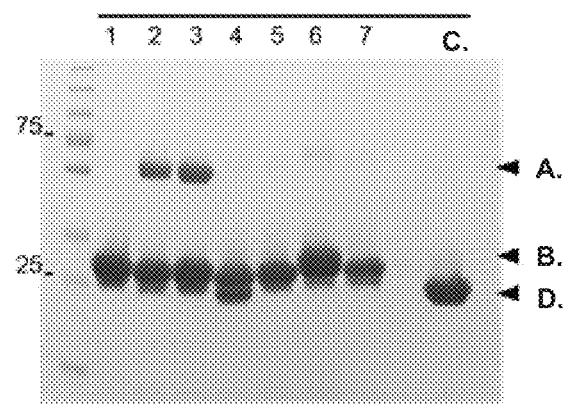
Figure 3:
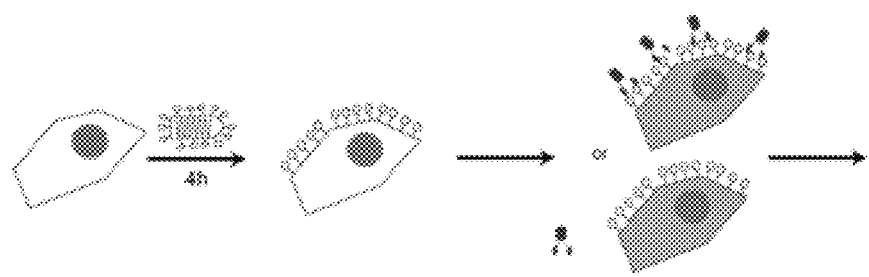
Figure 4A:
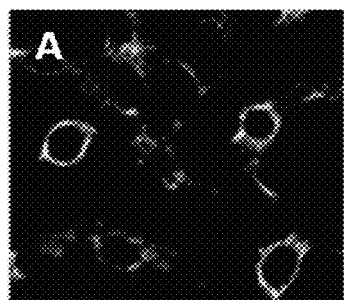
Figure 4B:
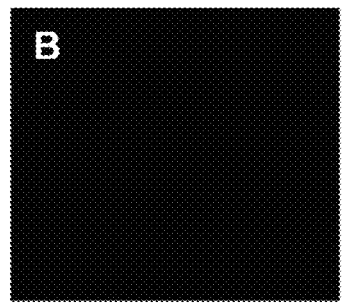
Figure 4C:
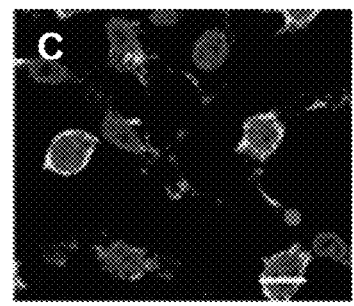
Figure 4D:
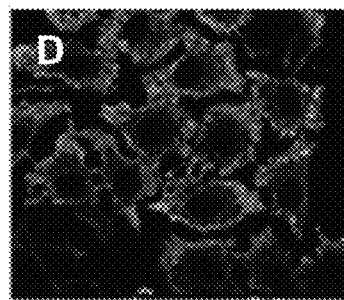
Figure 4E:
Figure 4F:
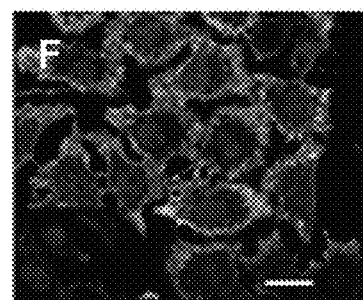
Figure 4G:
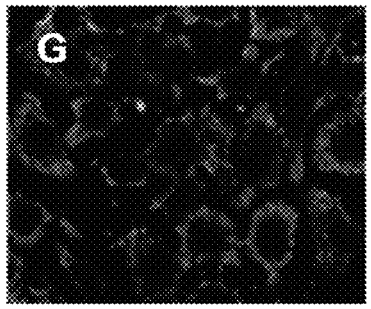
Figure 4H:
Figure 4I:
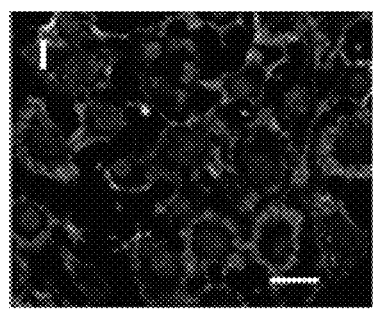
Figure 5:
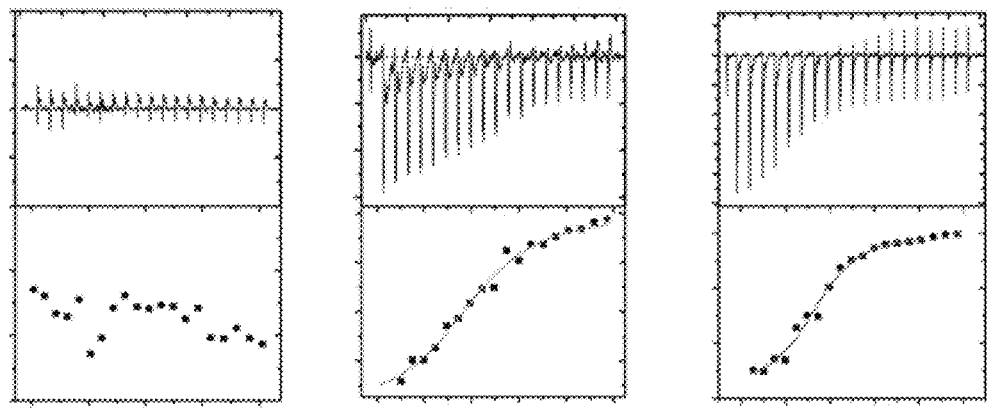
Figure 6A:
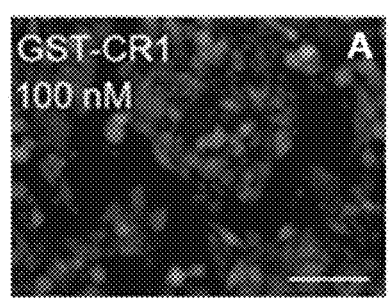
FIG. 6A represents photograph of BRS cells infected with VSV-eGFP preincubated with GST-CR1 at the indicated concentrations.
Figure 6B:
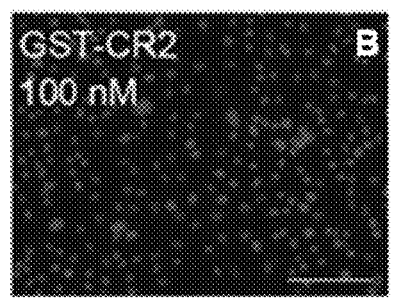
FIG. 6B represents photograph of BRS cells infected with VSV-eGFP preincubated with GST-CR2 at the indicated concentrations.
Figure 6C:
FIG. 6C represents photograph of BRS cells infected with VSV-eGFP preincubated with GST-CR3 at the indicated concentrations.
Figure 6D:
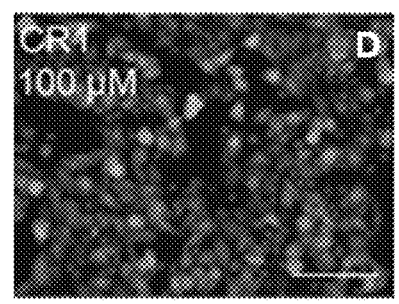
FIG. 6D represents photograph of BRS cells infected with VSV-eGFP preincubated with CR1 monovalent domain at the indicated concentrations.
Figure 6E:
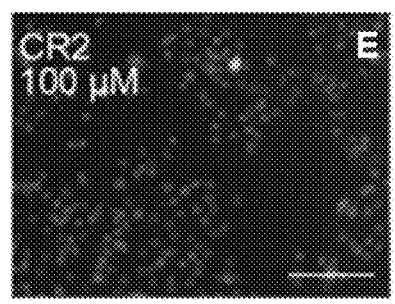
FIG. 6E represents photograph of BRS cells infected with VSV-eGFP preincubated with CR2 monovalent domain at the indicated concentrations.
Figure 6F:
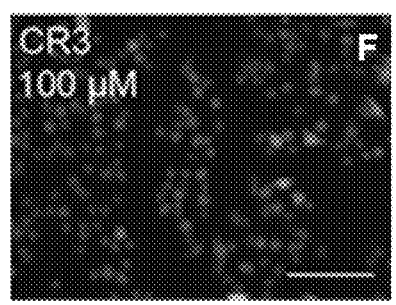
FIG. 6F represents photograph of BRS cells infected with VSV-eGFP preincubated with CR3 monovalent domain at the indicated concentrations.

The inventors have expressed individually each LDL-R CR domain in fusion with the glutathione S-transferase (GST) in *E. coli*. Each fusion protein was incubated at pH 8 with magnetic beads coated with glutathione before addition of a soluble form of the ectodomain of G (VSV Gth, amino acid (AA) residues 1-422, generated by thermolysine limited proteolysis of viral particles (FIG. 2). After 20 minutes of incubation at 4° C., the beads were washed and the associated proteins were analyzed by SDS/PAGE followed by Coomassie blue staining. This revealed that only CR2 and CR3 domains are able to directly bind VSV G (FIG. 2) at pH 8. Additionally, GST-CR2 and GST-CR3 (but not GST-CR1) fluorescently labeled with ATTO550 (FIG. 3 and FIG. 4) specifically recognized VSV G expressed at the surface of infected cells. The inventors also used isothermal titration calorimetry (ITC) to investigate the binding parameters of CR1, CR2 and CR3 to Gth in solution (FIG. 5). Here again, no interaction between G and CR1 was detected. On the other hand, for both CR2 and CR3, the binding reactions appear to be exothermic, show a 1:1 stoichiometry and exhibit similar Kds (4.3+/−1 µM for CR3 and 7.3+/−1.5 µM for CR2).

Furthermore, recombinant soluble CR2 and CR3 domains, either alone or in fusion with GST, are also able to neutralize viral infectivity when incubated with the viral inoculum prior infection (FIG. 6).

Crystal Structures of VSV G Ectodomain in Complex with LDL-R CR Domains

Figure 7:
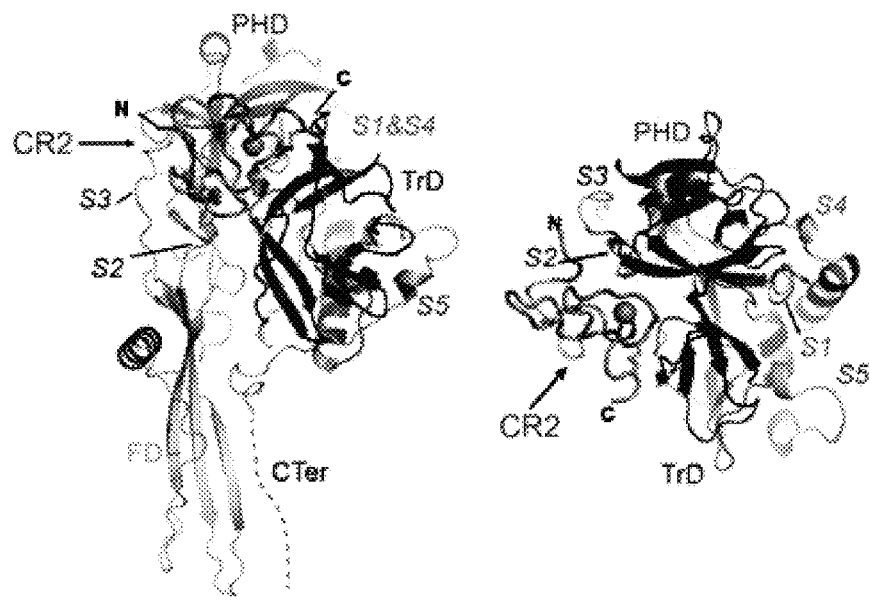
FIG. 7 is a tridimensional representation of GthCR2 crystalline structures in ribbon representation.
Figure 8:
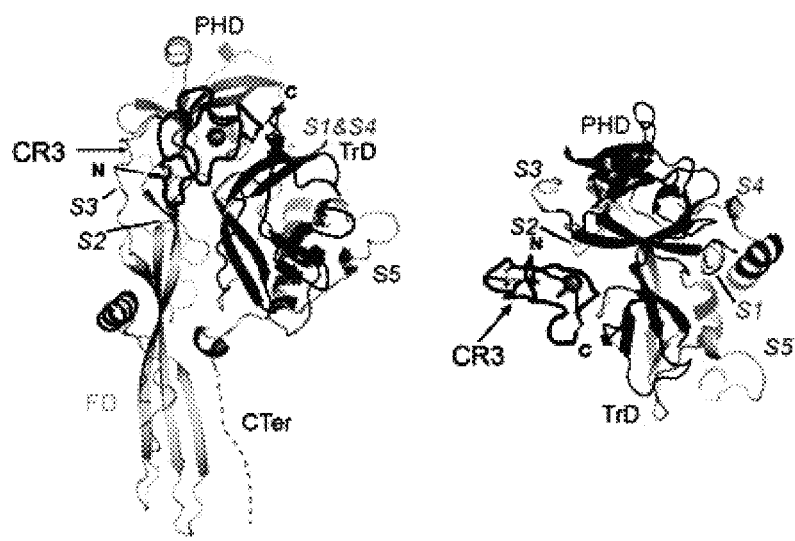
FIG. 8 is a tridimensional representation of GthCR3 crystalline structures in ribbon representation.

The inventors crystallized Gth in complex with either CR2 or CR3. The binding site of CR domains on G is the same in both crystal forms (FIG. 7 and FIG. 8).

Figure 10A:
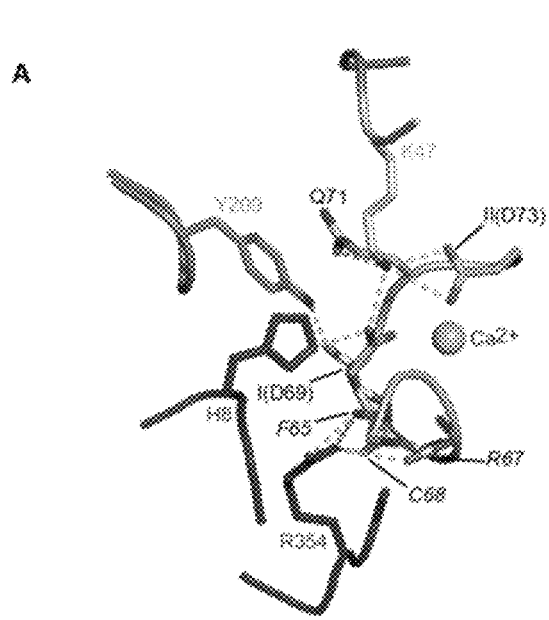
Figure 10B:
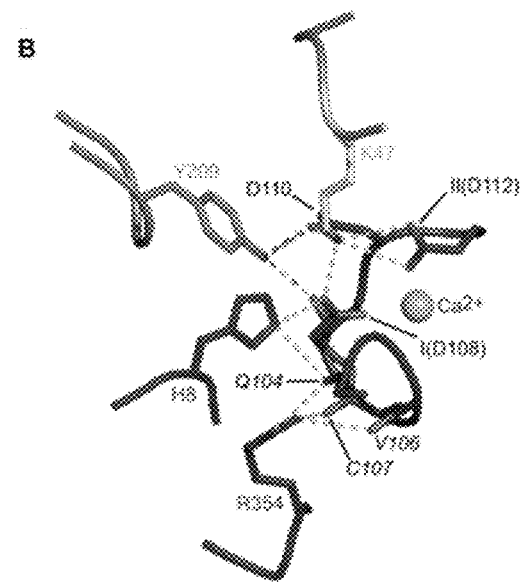
Figure 11A:
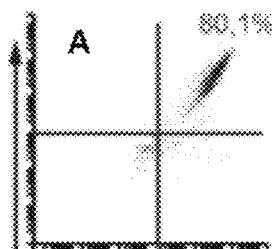
Figure 11B:
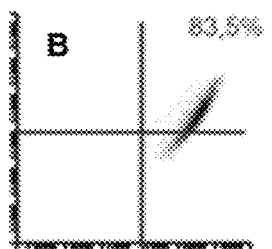
Figure 11C:
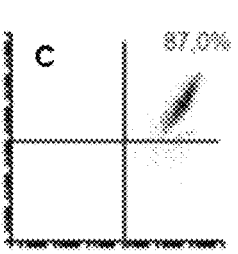
Figure 11D:
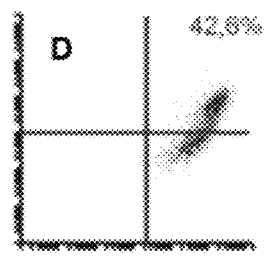
Figure 11E:
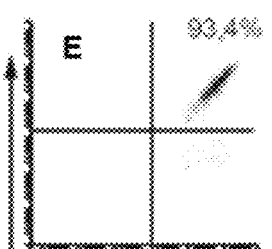
Figure 11F:
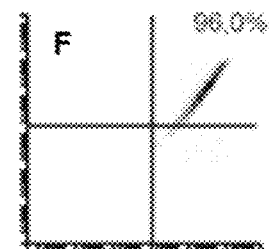
Figure 11G:
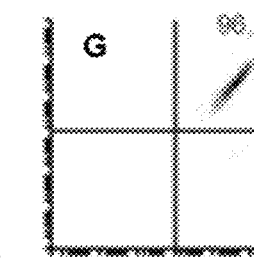
Figure 11H:
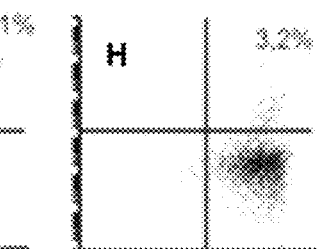
Figure 11I:
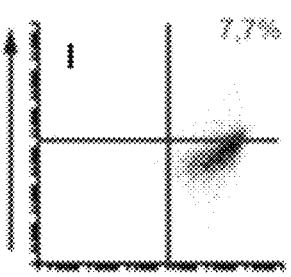
Figure 11J:
Figure 11K:
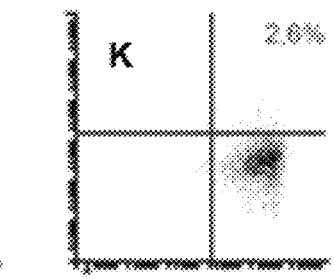
Figure 11L:
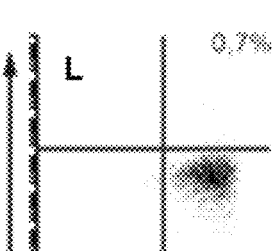
Figure 11M:
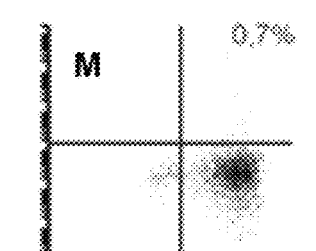
Figure 11N:
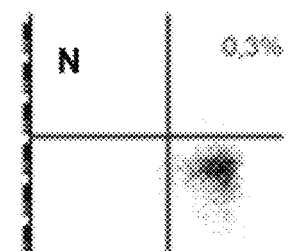
Figure 12:
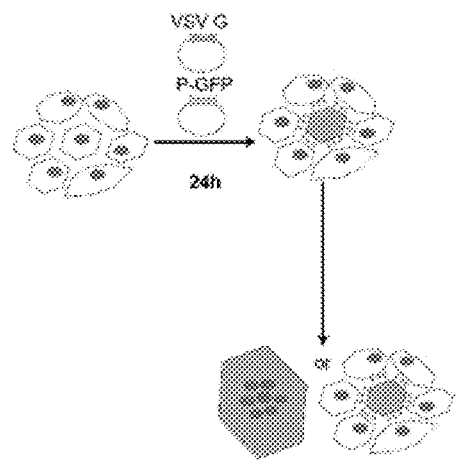

Two basic residues of G (H8 from the TrD and K47 from PHD) are pointing toward two acidic residues which belong to the octahedral calcium cage of the CR domains (D69 and D73 on CR2; D108 and D112 on CR3 labelled I and II—FIG. 9). Together with Y209 and R354, they seem to be key for the interaction (FIGS. 10A and B).

K47 and R354 are Key Residues of G Required for LDL-R CR Domains Binding

To investigate their contribution to LDL-R CR domains binding, the inventors mutated residues H8, K47, Y209 and R354 of G into an alanine or a glutamine. HEK293T cells were transfected with a plasmid encoding wild-type or mutant VSV G glycoproteins (WT, H8A, K47A, K47Q, Y209A, R354A and R354Q). Twenty-four hours post-transfection, the cells were incubated with a MAb against G ectodomain. Then, green fluorescent anti IgG secondary antibodies and GST-CR fusion proteins fluorescently labelled with ATTO550 were simultaneously added. Immunofluorescence labelling indicated that WT and all G mutants are efficiently transported to the cell surface (FIG. 11). Mutants H8A and Y209A bind GST-CR domains as WT G whereas the other mutants are affected in their binding ability (FIG. 11). Mutants K47Q, R354A and R354Q bind neither GST-CR2 nor GST-CR3. Finally, although no interaction is detected between mutant K47A and CR3, a residual binding activity is observed between this mutant and CR2 (FIG. 11).

The inventors also checked the fusion properties of mutants K47A and R354A. For this, BSR cells were transfected with pCAGGS plasmids encoding wild-type or mutant VSV G glycoproteins (WT, K47A and R354A). The cells expressing mutant G protein have a fusion phenotype similar to that of WT G (FIG. 13). This confirms that the mutant glycoproteins are correctly folded and demonstrates that it is possible to decouple G fusion activity and receptor recognition.

Other LDL-R Family Members are Alternative Receptors of VSV

HAP-1 cells in which the LDL-R gene has been knocked out (HAP-1 LDL-RKO) (FIG. 14) are as susceptible to VSV infection as WT HAP-1 cells (FIG. 15). This demonstrates that VSV receptors other than the LDL-R are present at the surface of HAP-1 cells.

To evaluate the role of other LDL-R family members as VSV receptors, the inventors took advantage of the properties of the receptor-associated protein (RAP), a common ligand of all LDL-R family members which blocks ligand binding to all LDL-R family members with the exception of LDL-R itself (Finkelshtein et al., 2013). RAP significantly inhibits VSV infection in HAP-1 LDL-RKO but not in WT HAP-1 cells (FIG. 15). Those results are consistent with previous data suggesting that VSV can use other LDL-R family members as alternative receptors (Finkelshtein et al., 2013).

G Mutants Affected in their CR Domain Binding Site Cannot Rescue a Recombinant VSV Lacking the G Gene The inventors then examined whether the mutant glycoproteins described above are able to sustain viral infection. The inventors used a recombinant VSV (VSVΔG-GFP) in which the G envelope gene was replaced by the green fluorescent protein (GFP) gene and which was pseudotyped with the VSV G glycoprotein. This pseudotyped recombinant was used to infect HEK cells either transfected or not transfected by a plasmid encoding WT or mutant glycoproteins (Ferlin et al., 2014). After 8 h, the infected cells supernatant was collected (FIG. 16). Mutant glycoproteins incorporation into the envelope of the particles present in the supernatant was verified by western blot (FIG. 17) and the infectivity of the pseudotyped particles was analyzed in different cell lines (mammalian HEK, BSR, CHO and *Drosophila* S2 cells) by counting the cells expressing GFP by flow cytometry 4 h post-infection (p.i.) (FIG. 18). Mutants K47A, K47Q, R354A and R354Q did not rescue the infectivity of VSVΔG-GFP. Compared to WT G, the infectivity decreased by a factor of 10 up to 120 (FIG. 18). The decrease was more important in HEK and S2 cell lines than in the two hamster cell lines. In mammalian cell lines, mutants H8A and Y209A can rescue the infectivity of VSVΔG-GFP, but at a lower level than that of WT. In S2 cell line, their infectivity is significantly decreased (by a factor of 15 for mutant H8A and −6 for Y209A) (FIG. 18).

As the fusion activity of the mutants is unaffected, the loss of infectivity of pseudotypes bearing a mutant glycoprotein can be safely attributed to their disability to recognize a cellular receptor. These results indicate that mutants K47A, K47Q, R354A and R354Q which are unable to bind LDL-R CR domains are also severely impaired in their ability to bind other VSV receptors.

Discussion

LDL-R has been demonstrated to be the major entry port of VSV and lentivirus pseudotyped by VSV-G (Finkelshtein et al., 2013). Here, the inventors demonstrate that VSV-G is able to bind two CR domains of the LDL-R with similar affinities. The biological relevance of this interaction was demonstrated by the ability of both CR2 and CR3 to inhibit VSV infection. The crystal structures of VSV G in complex with CR2 and CR3 reveal that they both occupy the same site at the surface of the glycoprotein in its prefusion conformation and that the same G residues ensure the correct anchoring of the CR domains. This binding site is split apart when G is in its post-fusion conformation, which explains why G is unable to bind CR domains at low pH.

This may disrupt the interaction between G and LDL-R in the endosomal lumen and favour the transport of the virion to an appropriate fusion site.

CR domain recognition by VSV G involves basic residues K47 and R354 pointing toward the calcium-coordinating acidic residues. This mode of binding is very similar to what is observed for endogenous ligand recognition by CR domains of the LDL-R family members and, indeed, mutant glycoproteins in which either K47 or R354 is replaced by an alanine or a glutamine, are unable to bind CR domains. It is worth noting that those key residues are not conserved among vesiculoviruses. Therefore, the use of LDL-R as a viral receptor cannot be generalized to the other members of the genus. Indeed, the inventors have shown that CHAV G, which does not possess basic residues in positions corresponding to VSV residues 47 and 354, does not bind CR domains.

The inventor's functional analysis confirms that LDL-R is not the only receptor of VSV as HAP-1 LDL-RKO can be infected as efficiently as HAP-1 cells. However, the mutant glycoproteins which are unable to bind CR domains cannot restore VSVΔG-GFP infectivity neither in mammalian nor in insect cells. The most parsimonious interpretation of this result is that the only receptors of VSV in HEK cells are members of the LDL-R family. The molecular basis of the interaction is the same for all those receptors and involves G ability to bind their CR domains. This is in agreement with the decrease of infectivity observed in presence of RAP protein which is an antagonist of other members of the LDL-R family. Overall this study demonstrates that VSV G has specifically evolved to interact with CR domains of the members of the LDL-R family. The ubiquitous nature of this receptor family (which is also widespread among invertebrates) explains the pantropism of VSV.

The demonstration that the receptors of VSV are all members of the LDL-R family together with the characterization of the molecular basis of CR domains recognition by G paves the way to develop recombinant VSVs with modified tropism. Indeed, a glycoprotein having (i) a point mutation which ablates the natural receptor tropism and (ii) an insertion of a protein domain or a peptide targeting specifically a tumor cell (Ammayappan et al., 2013) should allow the design of fully retargeted oncolytic VSVs. Such viruses should be able to eliminate cancerous cells while sparing normal ones.

Cells and Viruses

BSR, a clone of BHK-21 (Baby Hamster Kidney cells; ATCC CCL-10) and HEK-293T (human embryonic kidney cells expressing simian virus 40 T antigen; ATCC CRL-3216) cells were grown in Dulbecco's modified Eagle's medium (DMEM) supplemented with 10% fetal calf serum (FCS). HAP-1 wt and HAP-1 LDL-R deficient cells (HAP-1 LDL-RKO) purchased from Horizon Discovery) were grown in Iscove's Modified Dulbecco's Medium (IMDM) supplemented with 10% FCS. CHO (cell line derived from Chinese hamster ovaries) cells were grown in Ham's F12 medium supplemented with 2 mM glutamine and 10% FCS. All mammalian cell lines were maintained at 37° C. in a humidified incubator with 5% CO2. *Drosophila* S2 cells were grown in Schneider's medium supplemented with 10% FCS at 28° C.

Wild-type VSV (Mudd-Summer strain, Indiana serotype), VSVΔG-GCHAV (Rose et al., 2000) and VSV-eGFP were propagated in BSR cells.

VSVΔG-GFP is a recombinant VSV which was derived from a full-length cDNA clone of the VSV genome (Indiana serotype) in which the coding region of the G protein was replaced by a modified version of the GFP gene and pseudotyped with the VSV G protein (Ferlin et al., 2014). VSVΔG-GFP was propagated on HEK-293T cells that had been previously transfected with pCAGGS-VSVG.

Plasmids and Cloning

Point mutations were created starting from the cloned VSV G gene (Indiana Mudd-Summer strain) in the pCAGGS plasmid. Briefly, forward and reverse primers containing the desired mutation were combined separately with one of the primers flanking the G gene to generate two PCR products. These two G gene fragments overlap in the region containing the mutation and were assembled into the pCAGGS linearized vector using Gibson assembly reaction kit (New England Biolabs).

Protein Expression, Purification and Labelling

VSV Gth was obtained by limited proteolysis of viral particles and purified as previously described (Albertini et al., 2012a).

DNA sequences encoding the 7 CR domains of the human LDL-R (NM_000527, GenBank) were synthetized (MWG biotech) and subcloned in the pGEX-6P1 bacterial expression vector (Invitrogen). Each protein construct contains at its N-terminus a GST tag and a preScission protease cleavage site. Each CR domain was purified using the following protocol derived from (Harper and Speicher, 2011). C41 bacteria transformed with the CR construct were cultured at 37° in LB-ampicillin medium until OD reached 0.6 AU. Protein expression was then induced with 1 mM IPTG during 5 h at 37° C. Cells were sonicated in lysis buffer (500 mM NaCl, 20 mM Tris-HCl pH 8, 2 mM CaCl2, 2% w/v sarkosyl and 1 mM DTT). The clarified supernatant was incubated with glutathione agarose beads (Thermo Fisher Scientific) in presence of 0.2% Triton X100 during 2 h. After incubation, beads were then extensively washed with equilibration buffer (200 mM NaCl, 50 mM Tris HCl pH 8, 2 mM CaCl2, 1 mM PMSF). The GST-CR construct was then eluted with the same buffer supplemented with 20 mM GSH. Purification of each GST-CR was achieved with a gel filtration step using a Superdex 200 column (Ge Healthcare). To isolate CR domains, purified GST-CR was incubated with preScission protease and injected on a gel filtration column Superdex 75 (Ge Healthcare). Fractions containing pure CR domains were then pooled, concentrated at 1 mM and stored at −80° C. until use.

One milligram of purified GST-CR2 (or GST-CR3) was labelled with the fluorescent dye ATTO550 NHS ester (Sigma Aldrich) using the instruction of the manufacturer. The labelled proteins were then diluted at a concentration of 50 μM and stored at −80° C. until use. The labelling ratio was estimated to be around 2 dyes per molecule.

Characterization of the Binding Between G and CR Domains.

Purified GST-CR domains were incubated with magnetic beads coated with GSH (Eurogentec) under agitation during 20 min at 4° C. Then, the slurry was washed with the equilibration buffer at the appropriate pH (200 mM NaCl, 2 mM CaCl2, 50 mM Tris-HCl pH 8 or 50 mM MES-NaOH pH 6). Purified Gth or viral particles were preincubated in this same buffer for 20 min and added to the magnetic beads bound to GST-CR construction or GST alone. After 20 min of incubation under soft agitation, the slurry was washed two times with the equilibration buffer at the appropriate pH (either 8 or 6). Beads were re-suspended in the gel loading buffer and directly analyzed on a SDS PAGE.

Binding of CR Domains to Cells Expressing G (Either WT or Mutants)

For microscopy, BSR cells were infected for 4 h and were then incubated with GST-CR2ATTO550 or GST-CR3ATTO550 at 4° C. for 30 min. Cells were fixed with 4% paraformaldehyde and then permeabilized with 0.5% Triton X-100. Nucleoprotein was detected by using a mouse monoclonal anti-VSV N antibody. Goat anti-mouse Alexa fluor 488 (Invitrogen) was used as a secondary antibody. Images were captured using a Leica SP8 confocal microscope (63× oil-immersion objective).

For flow cytometry experiments, HEK-293T cells were transfected with pCAGGS plasmids encoding WT or mutant G using polyethylenimine (PEI, Sigma-Aldrich). 24 h after transfection, cells were collected and incubated with a mouse-monoclonal anti-G antibody that recognizes G ectodomain (8G5F11, KeraFast). Goat anti-mouse Alexa fluor 488 and GST-CR2ATTO550 (or GST-CR3ATTO550) were then simultaneously added to the cells. The fluorescence of cells was determined using a BD Accuri C6 flow cytometer.

Pseudotypes

HEK-293T cells at 80% confluence were transfected by pCAGGS encoding WT or mutant VSV G using PEI. At 24 h after transfection, cells were infected with VSVΔG-GFP at an MOI of 1. Two hours p.i., cells were washed to remove residual viruses from the inoculum. Cell supernatants containing the pseudotyped viral particles were collected at 16 h p.i. The infectious titers of the pseudotyped viruses were determined on non-transfected cells by counting cells expressing the GFP using a BD Accuri C6 flow cytometer at 4 h p.i. WT and mutant G incorporation in the pseudotyped particles was assessed after supernatant concentration by SDS PAGE and western blot analysis using an anti-VSV G and an anti-VSV M.

HAP-1 Cells Infection

HAP-1 cells were plated at 70% confluence and incubated, or not, with 50 nM of RAP during 15 min. Cells were then infected with VSV-eGFP at an MOI of 1. RAP was maintained during all the infection time. The percentage of infected cells (GFP-positive) was determined 4 h p.i. using a BD Accuri C6 flow cytometer.

ITC

ITC experiments were performed at 293 K using a Micro-Cal iTC200 apparatus (GE Healthcare) in a buffer composed of 150 mM NaCl, 20 mM Tris-HCl pH 8.0 and 2 mM CaCl2. Gth, at a concentration of 50 µM, was titrated by successive injections of CR domains at a concentration of 600 µM. The titration sequence included a first 1 µL injection followed by 19 injections of 2 µL each with a spacing of 180 or 240 s between injections. OriginLab software (GE Healthcare) was used to analyze the raw data. Binding parameters were extracted from curve fitting analysis with a single-site binding model.

Cell-Cell Fusion Assay

Cell-cell fusion assay was performed as previously described (Ferlin et al., 2014). Briefly, BSR cells plated on glass coverslips at 70% confluence were co-transfected with pCAGGS plasmids encoding WT G or mutant G, and P-GFP plasmid encoding the phosphoprotein of Rabies virus fused to GFP. Twenty four hours after transfection, cells were incubated with fusion buffer (DMEM-10 mM MES) at various pHs (from 5.0 to 7.5) for 10 minutes at 37°. Cells were then washed once and incubated with DMEM-10 mM HEPES-NaOH buffered at pH 7.4, 1% BSA at 37° C. for 1 hour. Cells were fixed with 4% paraformaldehyde in 1×PBS for 15 min. Cells nuclei were stained with DAPI and syncytia formation was analyzed with Zeiss Axiovert 200 fluorescence microscope with a 10× lens.

BIBLIOGRAPHY

Albertini, A. A. V., Baquero, E., Ferlin, A., and Gaudin, Y. (2012b). Molecular and Cellular Aspects of Rhabdovirus Entry. Viruses 4, 117-139.

Amirache, F., Levy, C., Costa, C., Mangeot, P. E., Torbett, B. E., Wang, C. X., Negre, D., Cosset, F. L., and Verhoeyen, E. (2014). Mystery solved: VSV-G-LVs do not allow efficient gene transfer into unstimulated T cells, B cells, and HSCs because they lack the LDL receptor. Blood 123, 1422-1424.

Ammayappan, A., Peng, K. W., and Russell, S. J. (2013). Characteristics of oncolytic vesicular stomatitis virus displaying tumor-targeting ligands. J Virol 87, 13543-13555.

Barber, G. N. (2005). VSV-tumor selective replication and protein translation. Oncogene 24, 7710-7719.

Ferlin, A., Raux, H., Baquero, E., Lepault, J., and Gaudin, Y. (2014). Characterization of pH-sensitive molecular switches that trigger the structural transition of vesicular stomatitis virus glycoprotein from the postfusion state toward the prefusion state. J Virol 88, 13396-13409.

Finkelshtein, D., Werman, A., Novick, D., Barak, S., and Rubinstein, M. (2013). LDL receptor and its family members serve as the cellular receptors for vesicular stomatitis virus. Proceedings of the National Academy of Sciences of the United States of America 110, 7306-7311.

Roche, S., Bressanelli, S., Rey, F. A., and Gaudin, Y. (2006). Crystal structure of the low-pH form of the vesicular stomatitis virus glycoprotein G. Science 313, 187-191.

Roche, S., Rey, F. A., Gaudin, Y., and Bressanelli, S. (2007). Structure of the prefusion form of the vesicular stomatitis virus glycoprotein g. Science 315, 843-848.

Example 2: Preparation of Plasmid Encoding Modified G

Construction of pCAGGS plasmids containing the desired coding G sequence with the mCherry inserted at various position were generated using Gibson assembly reaction.

The empty vector pCAGGS was linearized using EcoRI restriction enzyme. Then 3 PCR products with overlapping parts were generated. The product I is the fragment of G before the insertion site; it is generated running a PCR on the VSV G gene using primers Ia and $Ib_1$ to insert the mCherry in position 1 or Ia and $Ib_{351}$ to insert the mCherry in position 351. The product II is the mCherry gene (using primers $IIa_1$ and $IIb_1$ to insert the mCherry in position 1 or $IIa_{351}$ and $IIb_{351}$ to insert the mCherry in position 351). The product III is the fragment of G after the insertion site; it is generated using primers $IIIa_1$ and IIIb to insert the mCherry in position 1 or $IIIa_{351}$ and IIIb to insert the mCherry in position 351. Primer sequences were synthetized by Eurofins Genomics:

```
Ia:
                                    (SEQ ID NO : 332)
TCTCATCATTTTGGCAAAGATGAAGTGCCTTTTGTACTTAG

Ib₁:
                                    (SEQ ID NO: 333)
TTGCTCACCATGCAATTCACCCCAATGAATAAAAAG

Ib₃₅₁:
                                    (SEQ ID NO: 334)
GCTCACCATAGTTCCACTGATCATTCCGACC
```

```
-continued

IIa₁:
                                          (SEQ ID NO: 335)
CATTGGGGTGAATTGCATGGTGAGCAAGGGC

IIa₃₅₁:
                                          (SEQ ID NO: 336)
AATGATCAGTGGAACTATGGTGAGCAAGGGC

IIb₁:
                                          (SEQ ID NO: 337)
AAAIIb1CTATGGTGAACTTCTTGTACAGCTCGTCC

IIb₃₅₁:
                                          (SEQ ID NO: 338)
GTTCCCTTTCTGTGGTCTTGTACAGCTCGTCC

IIIa₁:
                                          (SEQ ID NO: 339)
GAGCTGTACAAGAAGTTCACCATAGTTTTTCCACACA

IIIa₃₅₁:
                                          (SEQ ID NO: 340)
CTGTACAAGACCACAGAAAGGGAACTGT

IIIb:
                                          (SEQ ID NO: 341)
CCGCCCGGGAGCTCGTTACTTTCCAAGTCGGTTC
```

After purification of each fragment on agarose gel, the 3 fragments plus the purified digested pCAGGS vector are then combined in equimolar concentration and assembled by Gibson assembly reaction. The DNA is then transformed into bacteria, and a correct plasmid product amplified after been identified by restriction digest and/or sequencing.

Example 3: Transient Expression of Modified VSV Glycoproteins

The transfection protocol will depend of the kind of cells to transduce. For HEK cells the inventors use PolyEthyenelmine (PEI) transfection protocol. For BHK the inventors use Ca-Phosphate transfection protocol or PEI.

Cells grown on coverslips were transfected with pCAGGS plasmid encoding for VSV modified glycoprotein. After 20 hour of transfection the cells were fixed with 4% paraformaldehyde in PBS. After washing (3 times with PBS) coverslides were mounted with immu-mount DAPI (thermofisher) and examined with a Zeiss microscope. Red fluorescence is present at the cell surface in both case indicating that the protein was correctly folded throw the Golgi apparatus (FIG. 19).

The invention is not limited to the above-mentioned embodiments.

SEQUENCE LISTING (341 sequences)

SEQ ID NO: 1 - protein, 495 aa, Vesicular stomatitis virus
KFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 2 - protein, 511 aa, Vesicular stomatitis virus
MKCLLYLAFLFIGVNCKFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 3 - protein, 496 aa, Vesicular stomatitis virus
KFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 4 - protein, 512 aa, Vesicular stomatitis virus
MLRLFLFCFLALGAHSKFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 5 - protein, 501 aa, Vesicular stomatitis virus
KIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 6 - protein, 517 aa, Vesicular stomatitis virus
MLSYLIFALVVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 7 - protein, 502 aa, Vesicular stomatitis virus
KITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 8 - protein, 523 aa, Vesicular stomatitis virus
MKMKMVIAGLILCIGILPAIGKITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 9 - protein, 494 aa, Vesicular stomatitis virus
KFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 10 - protein, 511 aa, Vesicular stomatitis virus
MTPAFILCMLLAGSSWAKFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 11 - protein, 495 aa, Vesicular stomatitis virus
KFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 12 - protein, 512 aa, Vesicular stomatitis virus
MNFLLLTFIVLPLCSHAKFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 13 - protein, 496 aa, Vesicular stomatitis virus
KFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 14 - protein, 513 aa, Vesicular stomatitis virus
MLVLYLLLSLLALGAQCKFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 15 - protein, 495 aa, Vesicular stomatitis virus
  misc_feature (47)..(47): Xaa can be any naturally occurring amino acid except Lys or Arg
KFTIVFPHNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 16 - protein, 495 aa, Vesicular stomatitis virus
  misc_feature (354)..(354): Xaa can be any naturally occurring amino acid except Lys or Arg
KFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 17 - protein, 495 aa, Vesicular stomatitis virus
  misc_feature (47)..(47): Xaa can be any naturally occurring amino acid except Lys or Arg
  misc_feature (354)..(354): Xaa can be any naturally occurring amino acid except Lys or Arg
KFTIVFPHNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 18 - protein, 511 aa, Vesicular stomatitis virus
  misc_feature (63)..(63): Xaa can be any naturally occurring amino acid except Lys or Arg
MKCLLYLAFLFIGVNCKFTIVFPHNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 19 - protein, 511 aa, Vesicular stomatitis virus
  misc_feature (370)..(370): Xaa can be any naturally occurring amino acid except Lys or Arg
MKCLLYLAFLFIGVNCKFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 20 - protein, 511 aa, Vesicular stomatitis virus
  misc_feature (63)..(63): Xaa can be any naturally occurring amino acid except Lys or Arg
  misc_feature (370)..(370): Xaa can be any naturally occurring amino acid except Lys or Arg
MKCLLYLAFLFIGVNCKFTIVFPHNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 21 - protein, 496 aa, Vesicular stomatitis virus
  misc_feature (47)..(47): Xaa can be any naturally occurring amino acid except Lys or Arg
KFTIVFPHHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 22 - protein, 496 aa, Vesicular stomatitis virus
  misc_feature (354)..(354): Xaa can be any naturally occurring amino acid except Lys or Arg
KFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 23 - protein, 496 aa, Vesicular stomatitis virus
  misc_feature (47)..(47): Xaa can be any naturally occurring amino acid except Lys or Arg
  misc_feature (354)..(354): Xaa can be any naturally occurring amino acid except Lys or Arg
KFTIVFPHHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 24 - protein, 512 aa, Vesicular stomatitis virus
  misc_feature (63)..(63): Xaa can be any naturally occurring amino acid except Lys or Arg
MLRLFLFCFLALGAHSKFTIVFPHHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 25 - protein, 512 aa, Vesicular stomatitis virus
  misc_feature (370)..(370): Xaa can be any naturally occurring amino acid except Lys or Arg
MLRLFLFCFLALGAHSKFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 26 - protein, 512 aa, Vesicular stomatitis virus
  misc_feature (63)..(63): Xaa can be any naturally occurring amino acid except Lys or Arg
  misc_feature (370)..(370): Xaa can be any naturally occurring amino acid except Lys or Arg
MLRLFLFCFLALGAHSKFTIVFPHHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 27 - protein, 501 aa, Vesicular stomatitis virus
  misc_feature (47)..(47): Xaa can be any naturally occurring amino acid except Lys or Arg
KIEIVFPQHTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 28 - protein, 501 aa, Vesicular stomatitis virus
  misc_feature (358)..(358): Xaa can be any naturally occurring amino acid except Lys or Arg
KIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 29 - protein, 501 aa, Vesicular stomatitis virus
  misc_feature (47)..(47): Xaa can be any naturally occurring amino acid except Lys or Arg
  misc_feature (358)..(358): Xaa can be any naturally occurring amino acid except Lys or Arg
KIEIVFPQHTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 30 - protein, 517 aa, Vesicular stomatitis virus
  misc_feature (63)..(63): Xaa can be any naturally occurring amino acid except Lys or Arg
MLSYLIFALVVSPILGKIEIVFPQHTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 31 - protein, 517 aa, Vesicular stomatitis virus
  misc_feature (374)..(374): Xaa can be any naturally occurring amino acid except Lys or Arg
MLSYLIFALVVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 32 - protein, 517 aa, Vesicular stomatitis virus
  misc_feature (63)..(63): Xaa can be any naturally occurring amino acid except Lys or Arg
  misc_feature (374)..(374): Xaa can be any naturally occurring amino acid except Lys or Arg
MLSYLIFALVVSPILGKIEIVFPQHTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 33 - protein, 502 aa, Vesicular stomatitis virus
  misc_feature (47)..(47): Xaa can be any naturally occurring amino acid except Lys or Arg
KITISFPQSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 34 - protein, 502 aa, Vesicular stomatitis virus
  misc_feature (358)..(358): Xaa can be any naturally occurring amino acid except Lys or Arg
KITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 35 - protein, 502 aa, Vesicular stomatitis virus
  misc_feature (47)..(47): Xaa can be any naturally occurring amino acid except Lys or Arg
  misc_feature (358)..(358): Xaa can be any naturally occurring amino acid except Lys or Arg
KITISFPQSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 36 - protein, 523 aa, Vesicular stomatitis virus
  misc_feature (68)..(68): Xaa can be any naturally occurring amino acid except Lys or Arg
MKMKMVIAGLILCIGILPAIGKITISFPQSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 37 - protein, 523 aa, Vesicular stomatitis virus
  misc_feature (379)..(379): Xaa can be any naturally occurring amino acid except Lys or Arg
MKMKMVIAGLILCIGILPAIGKITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 38 - protein, 523 aa, Vesicular stomatitis virus
  misc_feature (68)..(68): Xaa can be any naturally occurring amino acid except Lys or Arg
  misc_feature (379)..(379): Xaa can be any naturally occurring amino acid except Lys or Arg
MKMKMVIAGLILCIGILPAIGKITISFPQSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 39 - protein, 494 aa, Vesicular stomatitis virus
  misc_feature (47)..(47): Xaa can be any naturally occurring amino acid except Lys or Arg
KFTIVFPQSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 40 - protein, 494 aa, Vesicular stomatitis virus
  misc_feature (354)..(354): Xaa can be any naturally occurring amino acid except Lys or Arg
KFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 41 - protein, 494 aa, Vesicular stomatitis virus
  misc_feature (47)..(47): Xaa can be any naturally occurring amino acid except Lys or Arg
  misc_feature (354)..(354): Xaa can be any naturally occurring amino acid except Lys or Arg
KFTIVFPQSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 42 - protein, 511 aa, Vesicular stomatitis virus
  misc_feature (64)..(64): Xaa can be any naturally occurring amino acid except Lys or Arg
MTPAFILCMLLAGSSWAKFTIVFPQSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 43 - protein, 511 aa, Vesicular stomatitis virus
  misc_feature (371)..(371): Xaa can be any naturally occurring amino acid except Lys or Arg
MTPAFILCMLLAGSSWAKFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 44 - protein, 511 aa, Vesicular stomatitis virus
  misc_feature (64)..(64): Xaa can be any naturally occurring amino acid except Lys or Arg
  misc_feature (371)..(371): Xaa can be any naturally occurring amino acid except Lys or Arg
MTPAFILCMLLAGSSWAKFTIVFPQSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 45 - protein, 495 aa, Vesicular stomatitis virus
  misc_feature (47)..(47): Xaa can be any naturally occurring amino acid except Lys or Arg
KFSIVFPQSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 46 - protein, 495 aa, Vesicular stomatitis virus
  misc_feature (354)..(354): Xaa can be any naturally occurring amino acid except Lys or Arg
KFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 47 - protein, 495 aa, Vesicular stomatitis virus
  misc_feature (47)..(47): Xaa can be any naturally occurring amino acid except Lys or Arg
  misc_feature (354)..(354): Xaa can be any naturally occurring amino acid except Lys or Arg
KFSIVFPQSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 48 - protein, 512 aa, Vesicular stomatitis virus
  misc_feature (64)..(64): Xaa can be any naturally occurring amino acid except Lys or Arg
MNFLLLTFIVLPLCSHAKFSIVFPQSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 49 - protein, 512 aa, Vesicular stomatitis virus
  misc_feature (371)..(371): Xaa can be any naturally occurring amino acid except Lys or Arg
MNFLLLTFIVLPLCSHAKFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 50 - protein, 512 aa, Vesicular stomatitis virus
  misc_feature (64)..(64): Xaa can be any naturally occurring amino acid except Lys or Arg
  misc_feature (371)..(371): Xaa can be any naturally occurring amino acid except Lys or Arg
MNFLLLTFIVLPLCSHAKFSIVFPQSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 51 - protein, 496 aa, Vesicular stomatitis virus
  misc_feature (47)..(47): Xaa can be any naturally occurring amino acid except Lys or Arg
KFTIVFPHNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 52 - protein, 496 aa, Vesicular stomatitis virus
  misc_feature (354)..(354): Xaa can be any naturally occurring amino acid except Lys or Arg
KFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 53 - protein, 496 aa, Vesicular stomatitis virus
  misc_feature (47)..(47): Xaa can be any naturally occurring amino acid except Lys or Arg
  misc_feature (354)..(354): Xaa can be any naturally occurring amino acid except Lys or Arg
KFTIVFPHNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 54 - protein, 513 aa, Vesicular stomatitis virus
  misc_feature (64)..(64): Xaa can be any naturally occurring amino acid except Lys or Arg
MLVLYLLLSLLALGAQCKFTIVFPHNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 55 - protein, 513 aa, Vesicular stomatitis virus
  misc_feature (371)..(371): Xaa can be any naturally occurring amino acid except Lys or Arg
MLVLYLLLSLLALGAQCKFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 56 - protein, 513 aa, Vesicular stomatitis virus
  misc_feature (64)..(64): Xaa can be any naturally occurring amino acid except Lys or Arg
  misc_feature (371)..(371): Xaa can be any naturally occurring amino acid except Lys or Arg
MLVLYLLLSLLALGAQCKFTIVFPHNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 57 - protein, 495 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
KFTIVFPXNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 58 - protein, 495 aa, Vesicular stomatitis virus
  misc_feature (8)..(8): Xaa can be any naturally occurring amino acid except Lys or Arg
  misc_feature (354)..(354): Xaa can be any naturally occurring amino acid except Lys or Arg
KFTIVFPXNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 59 - protein, 495 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
  misc_feature (354)..(354): Xaa can be any naturally occurring amino acid except Lys or Arg
KFTIVFPXNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 60 - protein, 495 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
KFTIVFPHNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNXFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 61 - protein, 495 aa, Vesicular stomatitis virus
  misc_feature (209)..(209): Xaa can be any naturally occurring amino acid except Lys or Arg
  misc_feature (354)..(354): Xaa can be any naturally occurring amino acid except Lys or Arg
KFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNXFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 62 - protein, 495 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
  misc_feature (354)..(354): Xaa can be any naturally occurring amino acid except Lys or Arg
KFTIVFPHNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNXFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 63 - protein, 495 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
  misc_feature (209)..(209): Xaa can be any naturally occurring amino acid except Lys or Arg
KFTIVFPXNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNXFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 64 - protein, 511 aa, Vesicular stomatitis virus
  misc_feature (24)..(24): Xaa can be any naturally occurring amino acid except Lys or Arg
  misc_feature (63)..(63): Xaa can be any naturally occurring amino acid except Lys or Arg
MKCLLYLAFLFIGVNCKFTIVFPXNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 65 - protein, 511 aa, Vesicular stomatitis virus
  misc_feature (24)..(24): Xaa can be any naturally occurring amino acid except Lys or Arg
  misc_feature (370)..(370): Xaa can be any naturally occurring amino acid except Lys or Arg
MKCLLYLAFLFIGVNCKFTIVFPXNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 66 - protein, 511 aa, Vesicular stomatitis virus
  misc_feature (24)..(24): Xaa can be any naturally occurring amino acid except Lys or Arg
  misc_feature (63)..(63): Xaa can be any naturally occurring amino acid except Lys or Arg
  misc_feature (370)..(370): Xaa can be any naturally occurring amino acid except Lys or Arg
MKCLLYLAFLFIGVNCKFTIVFPXNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 67 - protein, 511 aa, Vesicular stomatitis virus
  misc_feature (63)..(63): Xaa can be any naturally occurring amino acid except Lys or Arg
  misc_feature (225)..(225): Xaa can be any naturally occurring amino acid except Lys or Arg
MKCLLYLAFLFIGVNCKFTIVFPHNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNXFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 68 - protein, 511 aa, Vesicular stomatitis virus
  misc_feature (225)..(225): Xaa can be any naturally occurring amino acid except Lys or Arg
  misc_feature (370)..(370): Xaa can be any naturally occurring amino acid except Lys or Arg
MKCLLYLAFLFIGVNCKFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNXFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 69 - protein, 511 aa, Vesicular stomatitis virus
  misc_feature (63)..(63): Xaa can be any naturally occurring amino acid except Lys or Arg
  misc_feature (225)..(225): Xaa can be any naturally occurring amino acid except Lys or Arg
  misc_feature (370)..(370): Xaa can be any naturally occurring amino acid except Lys or Arg
MKCLLYLAFLFIGVNCKFTIVFPHNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNXFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 70 - protein, 511 aa, Vesicular stomatitis virus
  misc_feature (24)..(24): Xaa can be any naturally occurring amino acid except Lys or Arg
  misc_feature (63)..(63): Xaa can be any naturally occurring amino acid except Lys or Arg
  misc_feature (225)..(225): Xaa can be any naturally occurring amino acid except Lys or Arg
  misc_feature (370)..(370): Xaa can be any naturally occurring amino acid except Lys or Arg
MKCLLYLAFLFIGVNCKFTIVFPXNQKGNWKNVPSNYHYCPSSSDLNWHNDLIGTAIQVKMPXSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNXFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEXELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 71 - protein, 496 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
KFTIVFPXHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 72 - protein, 496 aa, Vesicular stomatitis virus
  misc_feature (8)..(8): Xaa can be any naturally occurring amino acid except Lys or Arg
  misc_feature (354)..(354): Xaa can be any naturally occurring amino acid except Lys or Arg
KFTIVFPXHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 73 - protein, 496 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
  misc_feature (354)..(354): Xaa can be any naturally occurring amino acid except Lys or Arg
KFTIVFPXHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 74 - protein, 496 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
KFTIVFPHHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNXFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 75 - protein, 496 aa, Vesicular stomatitis virus
  misc_feature (209)..(209): Xaa can be any naturally occurring amino acid except Lys or Arg
  misc_feature (354)..(354): Xaa can be any naturally occurring amino acid except Lys or Arg
KFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNXFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 76 - protein, 496 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
  misc_feature (354)..(354): Xaa can be any naturally occurring amino acid except Lys or Arg
KFTIVFPHHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNXFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 77 - protein, 496 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
  misc_feature (209)..(209): Xaa can be any naturally occurring amino acid except Lys or Arg
  misc_feature (354)..(354): Xaa can be any naturally occurring amino acid except Lys or Arg
KFTIVFPXHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNXFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 78 - protein, 512 aa, Vesicular stomatitis virus
  misc_feature (24)..(24): Xaa can be any naturally occurring amino acid except Lys or Arg
  misc_feature (63)..(63): Xaa can be any naturally occurring amino acid except Lys or Arg
MLRLFLFCFLALGAHSKFTIVFPXHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 79 - protein, 512 aa, Vesicular stomatitis virus
  misc_feature (24)..(24): Xaa can be any naturally occurring amino acid except Lys or Arg
  misc_feature (370)..(370): Xaa can be any naturally occurring amino acid except Lys or Arg
MLRLFLFCFLALGAHSKFTIVFPXHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 80 - protein, 512 aa, Vesicular stomatitis virus
  misc_feature (24)..(24): Xaa can be any naturally occurring amino acid except Lys or Arg
  misc_feature (63)..(63): Xaa can be any naturally occurring amino acid except Lys or Arg
  misc_feature (370)..(370): Xaa can be any naturally occurring amino acid except Lys or Arg
MLRLFLFCFLALGAHSKFTIVFPXHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 81 - protein, 512 aa, Vesicular stomatitis virus
  misc_feature (63)..(63): Xaa can be any naturally occurring amino acid except Lys or Arg
  misc_feature (225)..(225): Xaa can be any naturally occurring amino acid except Lys or Arg
MLRLFLFCFLALGAHSKFTIVFPHHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNXFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 82 - protein, 512 aa, Vesicular stomatitis virus
  misc_feature (225)..(225): Xaa can be any naturally occurring amino acid except Lys or Arg
  misc_feature (370)..(370): Xaa can be any naturally occurring amino acid except Lys or Arg
MLRLFLFCFLALGAHSKFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNXFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 83 - protein, 512 aa, Vesicular stomatitis virus
  misc_feature (63)..(63): Xaa can be any naturally occurring amino acid except Lys or Arg
  misc_feature (225)..(225): Xaa can be any naturally occurring amino acid except Lys or Arg
  misc_feature (370)..(370): Xaa can be any naturally occurring amino acid except Lys or Arg
MLRLFLFCFLALGAHSKFTIVFPHHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNXFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 84 - protein, 512 aa, Vesicular stomatitis virus
  misc_feature (24)..(24): Xaa can be any naturally occurring amino acid except Lys or Arg
  misc_feature (63)..(63): Xaa can be any naturally occurring amino acid except Lys or Arg
  misc_feature (225)..(225): Xaa can be any naturally occurring amino acid except Lys or Arg
  misc_feature (370)..(370): Xaa can be any naturally occurring amino acid except Lys or Arg
MLRLFLFCFLALGAHSKFTIVFPXHQKGNWKNVPSTYHYCPSSSDQNWHNDLTGVSLHVKIPXSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNXFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEXELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 85 - protein, 501 aa, Vesicular stomatitis virus
  misc_feature (9)..(9): Xaa can be any naturally occurring amino acid except Lys or Arg
  misc_feature (47)..(47): Xaa can be any naturally occurring amino acid except Lys or Arg
KIEIVFPQXTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 86 - protein, 501 aa, Vesicular stomatitis virus
  misc_feature (9)..(9): Xaa can be any naturally occurring amino acid except Lys or Arg
  misc_feature (358)..(358): Xaa can be any naturally occurring amino acid except Lys or Arg
KIEIVFPQXTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 87 - protein, 501 aa, Vesicular stomatitis virus
  misc_feature (9)..(9): Xaa can be any naturally occurring amino acid except Lys or Arg
  misc_feature (47)..(47): Xaa can be any naturally occurring amino acid except Lys or Arg
  misc_feature (358)..(358): Xaa can be any naturally occurring amino acid except Lys or Arg
KIEIVFPQXTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 88 - protein, 501 aa, Vesicular stomatitis virus; identical to SEQ ID NO: 27
  misc_feature (47)..(47): Xaa can be any naturally occurring amino acid except Lys or Arg

SEQ ID NO: 89 - protein, 501 aa, Vesicular stomatitis virus
  misc_feature (209)..(209): Xaa can be any naturally occurring amino acid except Lys or Arg
  misc_feature (358)..(358): Xaa can be any naturally occurring amino acid except Lys or Arg
KIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNXFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 90 - protein, 501 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
  misc_feature (358)..(358): Xaa can be any naturally occurring amino acid except Lys or Arg
KIEIVFPQHTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNXFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 91 - protein, 501 aa, Vesicular stomatitis virus
  misc_feature (9)..(9): Xaa can be any naturally occurring amino acid except Lys or Arg
  misc_feature (47)..(47): Xaa can be any naturally occurring amino acid except Lys or Arg
  misc_feature (209)..(209): Xaa can be any naturally occurring amino acid except Lys or Arg
  misc_feature (358)..(358): Xaa can be any naturally occurring amino acid except Lys or Arg
KIEIVFPQXTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNXFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 92 - protein, 517 aa, Vesicular stomatitis virus
  misc_feature (25)..(25): Xaa can be any naturally occurring amino acid except Lys or Arg
  misc_feature (63)..(63): Xaa can be any naturally occurring amino acid except Lys or Arg
MLSYLIFALVVSPILGKIEIVFPQXTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 93 - protein, 517 aa, Vesicular stomatitis virus
  misc_feature (25)..(25): Xaa can be any naturally occurring amino acid except Lys or Arg
  misc_feature (374)..(374): Xaa can be any naturally occurring amino acid except Lys or Arg
MLSYLIFALVVSPILGKIEIVFPQXTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 94 - protein, 517 aa, Vesicular stomatitis virus
  misc_feature (25)..(25): Xaa can be any naturally occurring amino acid except Lys or Arg
  misc_feature (63)..(63): Xaa can be any naturally occurring amino acid except Lys or Arg
  misc_feature (374)..(374): Xaa can be any naturally occurring amino acid except Lys or Arg
MLSYLIFALVVSPILGKIEIVFPQXTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 95 - protein, 517 aa, Vesicular stomatitis virus
  misc_feature (63)..(63): Xaa can be any naturally occurring amino acid except Lys or Arg
  misc_feature (225)..(225): Xaa can be any naturally occurring amino acid except Lys or Arg
MLSYLIFALVVSPILGKIEIVFPQHTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNXFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 96 - protein, 517 aa, Vesicular stomatitis virus
  misc_feature (225)..(225): Xaa can be any naturally occurring amino acid except Lys or Arg
  misc_feature (374)..(374): Xaa can be any naturally occurring amino acid except Lys or Arg
MLSYLIFALVVSPILGKIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNXFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 97 - protein, 517 aa, Vesicular stomatitis virus
  misc_feature (63)..(63): Xaa can be any naturally occurring amino acid except Lys or Arg
  misc_feature (225)..(225): Xaa can be any naturally occurring amino acid except Lys or Arg
  misc_feature (374)..(374): Xaa can be any naturally occurring amino acid except Lys or Arg
MLSYLIFALVVSPILGKIEIVFPQHTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNXFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 98 - protein, 517 aa, Vesicular stomatitis virus
  misc_feature (25)..(25): Xaa can be any naturally occurring amino acid except Lys or Arg
  misc_feature (63)..(63): Xaa can be any naturally occurring amino acid except Lys or Arg
  misc_feature (225)..(225): Xaa can be any naturally occurring amino acid except Lys or Arg
  misc_feature (374)..(374): Xaa can be any naturally occurring amino acid except Lys or Arg
MLSYLIFALVVSPILGKIEIVFPQXTTGDWKRVPHEYNYCPTSADKNSHGTQTGIPVELTMPXGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNXFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVXQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 99 - protein, 502 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
KITISFPXSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 100 - protein, 502 aa, Vesicular stomatitis virus
  misc_feature (8)..(8): Xaa can be any naturally occurring amino acid except Lys or Arg
  misc_feature (358)..(358): Xaa can be any naturally occurring amino acid except Lys or Arg
KITISFPXSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 101 - protein, 502 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
  misc_feature (358)..(358): Xaa can be any naturally occurring amino acid except Lys or Arg
KITISFPXSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 102 - protein, 502 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
KITISFPQSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNXFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 103 - protein, 502 aa, Vesicular stomatitis virus
  misc_feature (209)..(209): Xaa can be any naturally occurring amino acid except Lys or Arg
  misc_feature (358)..(358): Xaa can be any naturally occurring amino acid except Lys or Arg
KITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNXFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 104 - protein, 502 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
  misc_feature (358)..(358): Xaa can be any naturally occurring amino acid except Lys or Arg
KITISFPQSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNXFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 105 - protein, 502 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
  misc_feature (209)..(209): Xaa can be any naturally occurring amino acid except Lys or Arg
  misc_feature (358)..(358): Xaa can be any naturally occurring amino acid except Lys or Arg
KITISFPXSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNXFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 106 - protein, 523 aa, Vesicular stomatitis virus
  misc_feature (29)..(29): Xaa can be any naturally occurring amino acid except Lys or Arg
  misc_feature (68)..(68): Xaa can be any naturally occurring amino acid except Lys or Arg
MKMKMVIAGLILCIGILPAIGKITISFPXSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 107 - protein, 523 aa, Vesicular stomatitis virus
  misc_feature (29)..(29): Xaa can be any naturally occurring amino acid except Lys or Arg
  misc_feature (379)..(379): Xaa can be any naturally occurring amino acid except Lys or Arg
MKMKMVIAGLILCIGILPAIGKITISFPXSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 108 - protein, 523 aa, Vesicular stomatitis virus
  misc_feature (29)..(29): Xaa can be any naturally occurring amino acid except Lys or Arg
  misc_feature (68)..(68): Xaa can be any naturally occurring amino acid except Lys or Arg
  misc_feature (379)..(379): Xaa can be any naturally occurring amino acid except Lys or Arg
MKMKMVIAGLILCIGILPAIGKITISFPXSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 109 - protein, 523 aa, Vesicular stomatitis virus
  misc_feature (68)..(68): Xaa can be any naturally occurring amino acid except Lys or Arg
  misc_feature (230)..(230): Xaa can be any naturally occurring amino acid except Lys or Arg
MKMKMVIAGLILCIGILPAIGKITISFPQSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNXFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 110 - protein, 523 aa, Vesicular stomatitis virus
  misc_feature (230)..(230): Xaa can be any naturally occurring amino acid except Lys or Arg
  misc_feature (379)..(379): Xaa can be any naturally occurring amino acid except Lys or Arg
MKMKMVIAGLILCIGILPAIGKITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNXFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 111 - protein, 523 aa, Vesicular stomatitis virus
  misc_feature (68)..(68): Xaa can be any naturally occurring amino acid except Lys or Arg
  misc_feature (230)..(230): Xaa can be any naturally occurring amino acid except Lys or Arg
  misc_feature (379)..(379): Xaa can be any naturally occurring amino acid except Lys or Arg
MKMKMVIAGLILCIGILPAIGKITISFPQSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNXFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 112 - protein, 523 aa, Vesicular stomatitis virus
  misc_feature (29)..(29): Xaa can be any naturally occurring amino acid except Lys or Arg
  misc_feature (68)..(68): Xaa can be any naturally occurring amino acid except Lys or Arg
  misc_feature (230)..(230): Xaa can be any naturally occurring amino acid except Lys or Arg
  misc_feature (379)..(379): Xaa can be any naturally occurring amino acid except Lys or Arg
MKMKMVIAGLILCIGILPAIGKITISFPXSLKGDWRPVPKGYNYCPTSADKNLHGDLIDIGLRLRAPXSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNXFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSXVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 113 - protein, 494 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
KFTIVFPXSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 114 - protein, 494 aa, Vesicular stomatitis virus
  misc_feature (8)..(8): Xaa can be any naturally occurring amino acid except Lys or Arg
  misc_feature (354)..(354): Xaa can be any naturally occurring amino acid except Lys or Arg
KFTIVFPXSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 115 - protein, 494 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
  misc_feature (354)..(354): Xaa can be any naturally occurring amino acid except Lys or Arg
KFTIVFPXSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 116 - protein, 494 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
KFTIVFPQSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNXFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 117 - protein, 494 aa, Vesicular stomatitis virus
  misc_feature (209)..(209): Xaa can be any naturally occurring amino acid except Lys or Arg
  misc_feature (354)..(354): Xaa can be any naturally occurring amino acid except Lys or Arg
KFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNXFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 118 - protein, 494 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
  misc_feature (354)..(354): Xaa can be any naturally occurring amino acid except Lys or Arg
KFTIVFPQSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNXFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 119 - protein, 494 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
  misc_feature (209)..(209): Xaa can be any naturally occurring amino acid except Lys or Arg
  misc_feature (354)..(354): Xaa can be any naturally occurring amino acid except Lys or Arg
KFTIVFPXSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNXFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 120 - protein, 511 aa, Vesicular stomatitis virus
  misc_feature (25)..(25): Xaa can be any naturally occurring amino acid except Lys or Arg
  misc_feature (64)..(64): Xaa can be any naturally occurring amino acid except Lys or Arg
MTPAFILCMLLAGSSWAKFTIVFPXSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 121 - protein, 511 aa, Vesicular stomatitis virus
  misc_feature (25)..(25): Xaa can be any naturally occurring amino acid except Lys or Arg
  misc_feature (371)..(371): Xaa can be any naturally occurring amino acid except Lys or Arg
MTPAFILCMLLAGSSWAKFTIVFPXSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 122 - protein, 511 aa, Vesicular stomatitis virus
  misc_feature (25)..(25): Xaa can be any naturally occurring amino acid except Lys or Arg
  misc_feature (64)..(64): Xaa can be any naturally occurring amino acid except Lys or Arg
  misc_feature (371)..(371): Xaa can be any naturally occurring amino acid except Lys or Arg
MTPAFILCMLLAGSSWAKFTIVFPXSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 123 - protein, 511 aa, Vesicular stomatitis virus
  misc_feature (64)..(64): Xaa can be any naturally occurring amino acid except Lys or Arg
  misc_feature (226)..(226): Xaa can be any naturally occurring amino acid except Lys or Arg
MTPAFILCMLLAGSSWAKFTIVFPQSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNXFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 124 - protein, 511 aa, Vesicular stomatitis virus
  misc_feature (226)..(226): Xaa can be any naturally occurring amino acid except Lys or Arg
  misc_feature (371)..(371): Xaa can be any naturally occurring amino acid except Lys or Arg
MTPAFILCMLLAGSSWAKFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNXFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 125 - protein, 511 aa, Vesicular stomatitis virus
  misc_feature (64)..(64): Xaa can be any naturally occurring amino acid except Lys or Arg
  misc_feature (226)..(226): Xaa can be any naturally occurring amino acid except Lys or Arg
  misc_feature (371)..(371): Xaa can be any naturally occurring amino acid except Lys or Arg
MTPAFILCMLLAGSSWAKFTIVFPQSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNXFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 126 - protein, 511 aa, Vesicular stomatitis virus
  misc_feature (25)..(25): Xaa can be any naturally occurring amino acid except Lys or Arg
  misc_feature (64)..(64): Xaa can be any naturally occurring amino acid except Lys or Arg
  misc_feature (226)..(226): Xaa can be any naturally occurring amino acid except Lys or Arg
  misc_feature (371)..(371): Xaa can be any naturally occurring amino acid except Lys or Arg
MTPAFILCMLLAGSSWAKFTIVFPXSQKGDWKDVPPNYRYCPSSADQNWHGDLLGVNIRAKMPXVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNXFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKXELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 127 - protein, 495 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
KFSIVFPXSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 128 - protein, 495 aa, Vesicular stomatitis virus
  misc_feature (8)..(8): Xaa can be any naturally occurring amino acid except Lys or Arg
  misc_feature (354)..(354): Xaa can be any naturally occurring amino acid except Lys or Arg
KFSIVFPXSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 129 - protein, 495 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
  misc_feature (354)..(354): Xaa can be any naturally occurring amino acid except Lys or Arg
KFSIVFPXSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 130 - protein, 495 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
KFSIVFPQSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNXFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 131 - protein, 495 aa, Vesicular stomatitis virus
  misc_feature (209)..(209): Xaa can be any naturally occurring amino acid except Lys or Arg
  misc_feature (354)..(354): Xaa can be any naturally occurring amino acid except Lys or Arg
KFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNXFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 132 - protein, 495 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
  misc_feature (354)..(354): Xaa can be any naturally occurring amino acid except Lys or Arg
KFSIVFPQSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNXFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 133 - protein, 495 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
  misc_feature (209)..(209): Xaa can be any naturally occurring amino acid except Lys or Arg
  misc_feature (354)..(354): Xaa can be any naturally occurring amino acid except Lys or Arg
KFSIVFPXSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNXFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 134 - protein, 512 aa, Vesicular stomatitis virus
  misc_feature (25)..(25): Xaa can be any naturally occurring amino acid except Lys or Arg
  misc_feature (64)..(64): Xaa can be any naturally occurring amino acid except Lys or Arg
MNFLLLTFIVLPLCSHAKFSIVFPXSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 135 - protein, 512 aa, Vesicular stomatitis virus
  misc_feature (25)..(25): Xaa can be any naturally occurring amino acid except Lys or Arg
  misc_feature (371)..(371): Xaa can be any naturally occurring amino acid except Lys or Arg
MNFLLLTFIVLPLCSHAKFSIVFPXSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 136 - protein, 512 aa, Vesicular stomatitis virus
  misc_feature (25)..(25): Xaa can be any naturally occurring amino acid except Lys or Arg
  misc_feature (64)..(64): Xaa can be any naturally occurring amino acid except Lys or Arg
  misc_feature (371)..(371): Xaa can be any naturally occurring amino acid except Lys or Arg
MNFLLLTFIVLPLCSHAKFSIVFPXSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 137 - protein, 512 aa, Vesicular stomatitis virus
  misc_feature (64)..(64): Xaa can be any naturally occurring amino acid except Lys or Arg
  misc_feature (226)..(226): Xaa can be any naturally occurring amino acid except Lys or Arg
MNFLLLTFIVLPLCSHAKFSIVFPQSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNXFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 138 - protein, 512 aa, Vesicular stomatitis virus
  misc_feature (226)..(226): Xaa can be any naturally occurring amino acid except Lys or Arg
  misc_feature (371)..(371): Xaa can be any naturally occurring amino acid except Lys or Arg
MNFLLLTFIVLPLCSHAKFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNXFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 139 - protein, 512 aa, Vesicular stomatitis virus
  misc_feature (64)..(64): Xaa can be any naturally occurring amino acid except Lys or Arg
  misc_feature (226)..(226): Xaa can be any naturally occurring amino acid except Lys or Arg
  misc_feature (371)..(371): Xaa can be any naturally occurring amino acid except Lys or Arg
MNFLLLTFIVLPLCSHAKFSIVFPQSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNXFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 140 - protein, 512 aa, Vesicular stomatitis virus
  misc_feature (25)..(25): Xaa can be any naturally occurring amino acid except Lys or Arg
  misc_feature (64)..(64): Xaa can be any naturally occurring amino acid except Lys or Arg
  misc_feature (226)..(226): Xaa can be any naturally occurring amino acid except Lys or Arg
  misc_feature (371)..(371): Xaa can be any naturally occurring amino acid except Lys or Arg
MNFLLLTFIVLPLCSHAKFSIVFPXSQKGNWKNVPSSYHYCPSSSDQNWHNDLLGITMKVKMPXTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNXFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEXELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 141 - protein, 496 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
KFTIVFPXNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 142 - protein, 496 aa, Vesicular stomatitis virus
  misc_feature (8)..(8): Xaa can be any naturally occurring amino acid except Lys or Arg
  misc_feature (354)..(354): Xaa can be any naturally occurring amino acid except Lys or Arg
KFTIVFPXNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 143 - protein, 496 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
  misc_feature (354)..(354): Xaa can be any naturally occurring amino acid except Lys or Arg
KFTIVFPXNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 144 - protein, 496 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
KFTIVFPHNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNXFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 145 - protein, 496 aa, Vesicular stomatitis virus
  misc_feature (209)..(209): Xaa can be any naturally occurring amino acid except Lys or Arg
  misc_feature (354)..(354): Xaa can be any naturally occurring amino acid except Lys or Arg
KFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNXFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 146 - protein, 496 aa, Vesicular stomatitis virus
  misc_feature (47)..(47): Xaa can be any naturally occurring amino acid except Lys or Arg
  misc_feature (209)..(209): Xaa can be any naturally occurring amino acid except Lys or Arg
  misc_feature (354)..(354): Xaa can be any naturally occurring amino acid except Lys or Arg
KFTIVFPHNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNXFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 147 - protein, 496 aa, Vesicular stomatitis virus
  misc_feature (8)..(8): Xaa can be any naturally occurring amino acid except Lys or Arg
  misc_feature (47)..(47): Xaa can be any naturally occurring amino acid except Lys or Arg
  misc_feature (209)..(209): Xaa can be any naturally occurring amino acid except Lys or Arg
  misc_feature (354)..(354): Xaa can be any naturally occurring amino acid except Lys or Arg
KFTIVFPXNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNXFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 148 - protein, 513 aa, Vesicular stomatitis virus
  misc_feature (25)..(25): Xaa can be any naturally occurring amino acid except Lys or Arg
  misc_feature (64)..(64): Xaa can be any naturally occurring amino acid except Lys or Arg
MLVLYLLLSLLALGAQCKFTIVFPXNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 149 - protein, 513 aa, Vesicular stomatitis virus
  misc_feature (25)..(25): Xaa can be any naturally occurring amino acid except Lys or Arg
  misc_feature (371)..(371): Xaa can be any naturally occurring amino acid except Lys or Arg
MLVLYLLLSLLALGAQCKFTIVFPXNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 150 - protein, 513 aa, Vesicular stomatitis virus
  misc_feature (25)..(25): Xaa can be any naturally occurring amino acid except Lys or Arg
  misc_feature (64)..(64): Xaa can be any naturally occurring amino acid except Lys or Arg
  misc_feature (371)..(371): Xaa can be any naturally occurring amino acid except Lys or Arg
MLVLYLLLSLLALGAQCKFTIVFPXNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 151 - protein, 513 aa, Vesicular stomatitis virus
  misc_feature (64)..(64): Xaa can be any naturally occurring amino acid except Lys or Arg
  misc_feature (226)..(226): Xaa can be any naturally occurring amino acid except Lys or Arg
MLVLYLLLSLLALGAQCKFTIVFPHNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNXFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 152 - protein, 513 aa, Vesicular stomatitis virus
  misc_feature (226)..(226): Xaa can be any naturally occurring amino acid except Lys or Arg
  misc_feature (371)..(371): Xaa can be any naturally occurring amino acid except Lys or Arg
MLVLYLLLSLLALGAQCKFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNXFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 153 - protein, 513 aa, Vesicular stomatitis virus
  misc_feature (64)..(64): Xaa can be any naturally occurring amino acid except Lys or Arg
  misc_feature (226)..(226): Xaa can be any naturally occurring amino acid except Lys or Arg
  misc_feature (371)..(371): Xaa can be any naturally occurring amino acid except Lys or Arg
MLVLYLLLSLLALGAQCKFTIVFPHNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNXFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 154 - protein, 513 aa, Vesicular stomatitis virus
  misc_feature (25)..(25): Xaa can be any naturally occurring amino acid except Lys or Arg
  misc_feature (64)..(64): Xaa can be any naturally occurring amino acid except Lys or Arg
  misc_feature (226)..(226): Xaa can be any naturally occurring amino acid except Lys or Arg
  misc_feature (371)..(371): Xaa can be any naturally occurring amino acid except Lys or Arg
MLVLYLLLSLLALGAQCKFTIVFPXNQKGNWKNVPANYQYCPSSSDLNWHNGLIGTSLQVKMPXSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNXFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEXELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 155 - protein, 495 aa, Vesicular stomatitis virus
KFTIVFPHNQKGNWKNVPSNYHYCPSSSDLNWHNDLIGTAIQVKMPASHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 156 - protein, 495 aa, Vesicular stomatitis virus
KFTIVFPHNQKGNWKNVPSNYHYCPSSSDLNWHNDLIGTAIQVKMPGSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 157 - protein, 495 aa, Vesicular stomatitis virus
KFTIVFPHNQKGNWKNVPSNYHYCPSSSDLNWHNDLIGTAIQVKMPFSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 158 - protein, 495 aa, Vesicular stomatitis virus
KFTIVFPHNQKGNWKNVPSNYHYCPSSSDLNWHNDLIGTAIQVKMPQSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTERELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 159 - protein, 495 aa, Vesicular stomatitis virus
KFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEAELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 160 - protein, 495 aa, Vesicular stomatitis virus
KFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEGELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 161 - protein, 495 aa, Vesicular stomatitis virus
KFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEFELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 162 - protein, 495 aa, Vesicular stomatitis virus
KFTIVFPHNQKGNWKNVPSNYHYCPSSSDLNWHNDLIGTAIQVKMPKSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEQELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 163 - protein, 495 aa, Vesicular stomatitis virus
KFTIVFPHNQKGNWKNVPSNYHYCPSSSDLNWHNDLIGTAIQVKMPASHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEAELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 164 - protein, 495 aa, Vesicular stomatitis virus
KFTIVFPHNQKGNWKNVPSNYHYCPSSSDLNWHNDLIGTAIQVKMPASHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEGELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 165 - protein, 495 aa, Vesicular stomatitis virus
KFTIVFPHNQKGNWKNVPSNYHYCPSSSDLNWHNDLIGTAIQVKMPASHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEFELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 166 - protein, 495 aa, Vesicular stomatitis virus
KFTIVFPHNQKGNWKNVPSNYHYCPSSSDLNWHNDLIGTAIQVKMPASHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEQELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 167 - protein, 495 aa, Vesicular stomatitis virus
KFTIVFPHNQKGNWKNVPSNYHYCPSSSDLNWHNDLIGTAIQVKMPGSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEAELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 168 - protein, 495 aa, Vesicular stomatitis virus
KFTIVFPHNQKGNWKNVPSNYHYCPSSSDLNWHNDLIGTAIQVKMPGSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEGELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 169 - protein, 495 aa, Vesicular stomatitis virus
KFTIVFPHNQKGNWKNVPSNYHYCPSSSDLNWHNDLIGTAIQVKMPGSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEFELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 170 - protein, 495 aa, Vesicular stomatitis virus
KFTIVFPHNQKGNWKNVPSNYHYCPSSSDLNWHNDLIGTAIQVKMPGSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEQELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 171 - protein, 495 aa, Vesicular stomatitis virus
KFTIVFPHNQKGNWKNVPSNYHYCPSSSDLNWHNDLIGTAIQVKMPFSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEAELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 172 - protein, 495 aa, Vesicular stomatitis virus
KFTIVFPHNQKGNWKNVPSNYHYCPSSSDLNWHNDLIGTAIQVKMPFSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEGELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 173 - protein, 495 aa, Vesicular stomatitis virus
KFTIVFPHNQKGNWKNVPSNYHYCPSSSDLNWHNDLIGTAIQVKMPFSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEFELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 174 - protein, 495 aa, Vesicular stomatitis virus
KFTIVFPHNQKGNWKNVPSNYHYCPSSSDLNWHNDLIGTAIQVKMPFSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEQELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 175 - protein, 495 aa, Vesicular stomatitis virus
KFTIVFPHNQKGNWKNVPSNYHYCPSSSDLNWHNDLIGTAIQVKMPQSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEAELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 176 - protein, 495 aa, Vesicular stomatitis virus
KFTIVFPHNQKGNWKNVPSNYHYCPSSSDLNWHNDLIGTAIQVKMPQSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEGELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 177 - protein, 495 aa, Vesicular stomatitis virus
KFTIVFPHNQKGNWKNVPSNYHYCPSSSDLNWHNDLIGTAIQVKMPQSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEFELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 178 - protein, 495 aa, Vesicular stomatitis virus
KFTIVFPHNQKGNWKNVPSNYHYCPSSSDLNWHNDLIGTAIQVKMPQSHKAIQADGWMCHASKWVTTCDFRWYGPKYITQSIRSFTPSVEQCKESIEQTKQGTWLNPGFPPQSCGYATVTDAEAVIVQVTPHHVLVDEYTGEWVDSQFINGKCSNYICPTVHNSTTWHSDYKVKGLCDSNLISMDITFFSEDGELSSLGKEGTGFRSNYFAYETGGKACKMQYCKHWGVRLPSGVWFEMADKDLFAAARFPECPEGSSISAPSQTSVDVSLIQDVERILDYSLCQETWSKIRAGLPISPVDLSYLAPKNPGTGPAFTIINGTLKYFETRYIRVDIAAPILSRMVGMISGTTTEQELWDDWAPYEDVEIGPNGVLRTSSGYKFPLYMIGHGMLDSDLHLSSKAQVFEHPHIQDAASQLPDDESLFFGDTGLSKNPIELVEGWFSSWKSSIASFFFIIGLIIGLFLVLRVGIHLCIKLKHTKKRQIYTDIEMNRLGK

SEQ ID NO: 179 - protein, 496 aa, Vesicular stomatitis virus
KFTIVFPHHQKGNWKNVPSTYHYCPSSSDQNWHNDLTGVSLHVKIPASHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 180 - protein, 496 aa, Vesicular stomatitis virus
KFTIVFPHHQKGNWKNVPSTYHYCPSSSDQNWHNDLTGVSLHVKIPGSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 181 - protein, 496 aa, Vesicular stomatitis virus
KFTIVFPHHQKGNWKNVPSTYHYCPSSSDQNWHNDLTGVSLHVKIPFSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 182 - protein, 496 aa, Vesicular stomatitis virus
KFTIVFPHHQKGNWKNVPSTYHYCPSSSDQNWHNDLTGVSLHVKIPQSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTERELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 183 - protein, 496 aa, Vesicular stomatitis virus
KFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEAELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 184 - protein, 496 aa, Vesicular stomatitis virus
KFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEGELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 185 - protein, 496 aa, Vesicular stomatitis virus
KFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEFELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 186 - protein, 496 aa, Vesicular stomatitis virus
KFTIVFPHHQKGNWKNVPSTYHYCPSSSDQNWHNDLTGVSLHVKIPKSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEQELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 187 - protein, 496 aa, Vesicular stomatitis virus
KFTIVFPHHQKGNWKNVPSTYHYCPSSSDQNWHNDLTGVSLHVKIPASHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEAELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 188 - protein, 496 aa, Vesicular stomatitis virus
KFTIVFPHHQKGNWKNVPSTYHYCPSSSDQNWHNDLTGVSLHVKIPASHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEGELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 189 - protein, 496 aa, Vesicular stomatitis virus
KFTIVFPHHQKGNWKNVPSTYHYCPSSSDQNWHNDLTGVSLHVKIPASHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEFELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 190 - protein, 496 aa, Vesicular stomatitis virus
KFTIVFPHHQKGNWKNVPSTYHYCPSSSDQNWHNDLTGVSLHVKIPASHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEQELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 191 - protein, 496 aa, Vesicular stomatitis virus
KFTIVFPHHQKGNWKNVPSTYHYCPSSSDQNWHNDLTGVSLHVKIPGSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEAELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 192 - protein, 496 aa, Vesicular stomatitis virus
KFTIVFPHHQKGNWKNVPSTYHYCPSSSDQNWHNDLTGVSLHVKIPGSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEGELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 193 - protein, 496 aa, Vesicular stomatitis virus
KFTIVFPHHQKGNWKNVPSTYHYCPSSSDQNWHNDLTGVSLHVKIPGSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEFELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 194 - protein, 496 aa, Vesicular stomatitis virus
KFTIVFPHHQKGNWKNVPSTYHYCPSSSDQNWHNDLTGVSLHVKIPGSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEQELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 195 - protein, 496 aa, Vesicular stomatitis virus
KFTIVFPHHQKGNWKNVPSTYHYCPSSSDQNWHNDLTGVSLHVKIPFSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEAELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 196 - protein, 496 aa, Vesicular stomatitis virus
KFTIVFPHHQKGNWKNVPSTYHYCPSSSDQNWHNDLTGVSLHVKIPFSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEGELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 197 - protein, 496 aa, Vesicular stomatitis virus
KFTIVFPHHQKGNWKNVPSTYHYCPSSSDQNWHNDLTGVSLHVKIPFSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEFELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 198 - protein, 496 aa, Vesicular stomatitis virus
KFTIVFPHHQKGNWKNVPSTYHYCPSSSDQNWHNDLTGVSLHVKIPFSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEQELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 199 - protein, 496 aa, Vesicular stomatitis virus
KFTIVFPHHQKGNWKNVPSTYHYCPSSSDQNWHNDLTGVSLHVKIPQSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEAELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 200 - protein, 496 aa, Vesicular stomatitis virus
KFTIVFPHHQKGNWKNVPSTYHYCPSSSDQNWHNDLTGVSLHVKIPQSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEGELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 201 - protein, 496 aa, Vesicular stomatitis virus
KFTIVFPHHQKGNWKNVPSTYHYCPSSSDQNWHNDLTGVSLHVKIPQSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEFELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 202 - protein, 496 aa, Vesicular stomatitis virus
KFTIVFPHHQKGNWKNVPSTYHYCPSSSDQNWHNDLTGVSLHVKIPQSHKAIQADGWMCHAAKWVTTCDFRWYGPKYITHSIHSMSPTLEQCKTSIEQTKQGVWINPGFPPQSCGYATVTDAEVVVVQATPHHVLVDEYTGEWIDSQLVGGKCSKEVCQTVHNSTVWHADYKITGLCESNLASVDITFFSEDGQKTSLGKPNTGFRSNHFAYESGEKACRMQYCTQWGIRLPSGVWFELVDKDLFQAAKLPECPRGSSISAPSQTSVDVSLIQDVERILDYSLCQETWSKIRAKLPVSPVDLSYLAPKNPGSGPAFTIINGTLKYFETRYIRVDISNPIIPHMVGTMSGTTTEQELWNDWYPYEDVEIGPNGVLKTPTGFKFPLYMIGHGMLDSDLHKSSQAQVFEHPHAKDAASQLPDDETLFFGDTGLSKNPVELVEGWFSSWKSTLASFFLIIGLGVALIFIIRIIVAIRYKYKGRKTQKIYNDVEMSRLGNK

SEQ ID NO: 203 - protein, 501 aa, Vesicular stomatitis virus
KIEIVFPQHTTGDWKRVPHEYNYCPTSADKNSHGTQTGIPVELTMPAGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 204 - protein, 501 aa, Vesicular stomatitis virus
KIEIVFPQHTTGDWKRVPHEYNYCPTSADKNSHGTQTGIPVELTMPFGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 205 - protein, 501 aa, Vesicular stomatitis virus
KIEIVFPQHTTGDWKRVPHEYNYCPTSADKNSHGTQTGIPVELTMPGGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 206 - protein, 501 aa, Vesicular stomatitis virus
KIEIVFPQHTTGDWKRVPHEYNYCPTSADKNSHGTQTGIPVELTMPQGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVRQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 207 - protein, 501 aa, Vesicular stomatitis virus
KIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVAQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 208 - protein, 501 aa, Vesicular stomatitis virus
KIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVFQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 209 - protein, 501 aa, Vesicular stomatitis virus
KIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVGQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 210 - protein, 501 aa, Vesicular stomatitis virus
KIEIVFPQHTTGDWKRVPHEYNYCPTSADKNSHGTQTGIPVELTMPKGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVQQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 211 - protein, 501 aa, Vesicular stomatitis virus
KIEIVFPQHTTGDWKRVPHEYNYCPTSADKNSHGTQTGIPVELTMPAGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVAQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 212 - protein, 501 aa, Vesicular stomatitis virus
KIEIVFPQHTTGDWKRVPHEYNYCPTSADKNSHGTQTGIPVELTMPAGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVFQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 213 - protein, 501 aa, Vesicular stomatitis virus
KIEIVFPQHTTGDWKRVPHEYNYCPTSADKNSHGTQTGIPVELTMPAGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVGQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 214 - protein, 501 aa, Vesicular stomatitis virus
KIEIVFPQHTTGDWKRVPHEYNYCPTSADKNSHGTQTGIPVELTMPAGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVQQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 215 - protein, 501 aa, Vesicular stomatitis virus
KIEIVFPQHTTGDWKRVPHEYNYCPTSADKNSHGTQTGIPVELTMPFGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVAQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 216 - protein, 501 aa, Vesicular stomatitis virus
KIEIVFPQHTTGDWKRVPHEYNYCPTSADKNSHGTQTGIPVELTMPFGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVFQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 217 - protein, 501 aa, Vesicular stomatitis virus
KIEIVFPQHTTGDWKRVPHEYNYCPTSADKNSHGTQTGIPVELTMPFGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVGQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 218 - protein, 501 aa, Vesicular stomatitis virus
KIEIVFPQHTTGDWKRVPHEYNYCPTSADKNSHGTQTGIPVELTMPFGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVQQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 219 - protein, 501 aa, Vesicular stomatitis virus
KIEIVFPQHTTGDWKRVPHEYNYCPTSADKNSHGTQTGIPVELTMPGGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVAQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 220 - protein, 501 aa, Vesicular stomatitis virus
KIEIVFPQHTTGDWKRVPHEYNYCPTSADKNSHGTQTGIPVELTMPGGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVFQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 221 - protein, 501 aa, Vesicular stomatitis virus
KIEIVFPQHTTGDWKRVPHEYNYCPTSADKNSHGTQTGIPVELTMPGGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVGQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 222 - protein, 501 aa, Vesicular stomatitis virus
KIEIVFPQHTTGDWKRVPHEYNYCPTSADKNSHGTQTGIPVELTMPGGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVQQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 223 - protein, 501 aa, Vesicular stomatitis virus
KIEIVFPQHTTGDWKRVPHEYNYCPTSADKNSHGTQTGIPVELTMPQGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVAQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 224 - protein, 501 aa, Vesicular stomatitis virus
KIEIVFPQHTTGDWKRVPHEYNYCPTSADKNSHGTQTGIPVELTMPQGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVFQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 225 - protein, 501 aa, Vesicular stomatitis virus
KIEIVFPQHTTGDWKRVPHEYNYCPTSADKNSHGTQTGIPVELTMPQGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVGQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 226 - protein, 501 aa, Vesicular stomatitis virus
KIEIVFPQHTTGDWKRVPHEYNYCPTSADKNSHGTQTGIPVELTMPQGLTTHQVDGFMCHSALWMTTCDFRWYGPKYITHSIHNEEPTDYQCLEAIKAYKDGVSFNPGFPPQSCGYGTVTDAEAHIVTVTPHSVKVDEYTGEWIDPHFIGGRCKGQICETVHNSTKWFTSSDGESVCSQLFTLVGGTFFSDSEEITSMGLPETGIRSNYFPYVSTEGICKMPFCRKPGYKLKNDLWFQITDPDLDKTVRDLPHIKDCDLSSSIVTPGEHATDISLISDVERILDYALCQNTWSKIEAGEPITPVDLSYLGPKNPGAGPVFTIINGSLHYFMSKYLRVELESPVIPRMEGKVAGTRIVQQLWDQWFPFGEVEIGPNGVLKTKQGYKFPLHIIGTGEVDNDIKMERIVKHWEHPHIEAAQTFLKKDDTEEVLYYGDTGVSKNPVELVEGWFSGWRSSIMGVLAVIIGFVILIFLIRLIGVLSSLFRQKRRPIYKSDVEMAHFR

SEQ ID NO: 227 - protein, 502 aa, Vesicular stomatitis virus
KITISFPQSLKGDWRPVPKGYNYCPTSADKNLHGDLIDIGLRLRAPASFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 228 - protein, 502 aa, Vesicular stomatitis virus
KITISFPQSLKGDWRPVPKGYNYCPTSADKNLHGDLIDIGLRLRAPFSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 229 - protein, 502 aa, Vesicular stomatitis virus
KITISFPQSLKGDWRPVPKGYNYCPTSADKNLHGDLIDIGLRLRAPGSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 230 - protein, 502 aa, Vesicular stomatitis virus
KITISFPQSLKGDWRPVPKGYNYCPTSADKNLHGDLIDIGLRLRAPQSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSRVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 231 - protein, 502 aa, Vesicular stomatitis virus
KITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSAVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 232 - protein, 502 aa, Vesicular stomatitis virus
KITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSFVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 233 - protein, 502 aa, Vesicular stomatitis virus
KITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSGVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 234 - protein, 502 aa, Vesicular stomatitis virus
KITISFPQSLKGDWRPVPKGYNYCPTSADKNLHGDLIDIGLRLRAPKSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSQVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 235 - protein, 502 aa, Vesicular stomatitis virus
KITISFPQSLKGDWRPVPKGYNYCPTSADKNLHGDLIDIGLRLRAPASFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSAVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 236 - protein, 502 aa, Vesicular stomatitis virus
KITISFPQSLKGDWRPVPKGYNYCPTSADKNLHGDLIDIGLRLRAPASFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSFVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 237 - protein, 502 aa, Vesicular stomatitis virus
KITISFPQSLKGDWRPVPKGYNYCPTSADKNLHGDLIDIGLRLRAPASFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSGVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 238 - protein, 502 aa, Vesicular stomatitis virus
KITISFPQSLKGDWRPVPKGYNYCPTSADKNLHGDLIDIGLRLRAPASFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSQVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 239 - protein, 502 aa, Vesicular stomatitis virus
KITISFPQSLKGDWRPVPKGYNYCPTSADKNLHGDLIDIGLRLRAPFSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSAVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 240 - protein, 502 aa, Vesicular stomatitis virus
KITISFPQSLKGDWRPVPKGYNYCPTSADKNLHGDLIDIGLRLRAPFSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSFVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 241 - protein, 502 aa, Vesicular stomatitis virus
KITISFPQSLKGDWRPVPKGYNYCPTSADKNLHGDLIDIGLRLRAPFSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSGVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 242 - protein, 502 aa, Vesicular stomatitis virus
KITISFPQSLKGDWRPVPKGYNYCPTSADKNLHGDLIDIGLRLRAPFSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSQVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 243 - protein, 502 aa, Vesicular stomatitis virus
KITISFPQSLKGDWRPVPKGYNYCPTSADKNLHGDLIDIGLRLRAPGSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSAVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 244 - protein, 502 aa, Vesicular stomatitis virus
KITISFPQSLKGDWRPVPKGYNYCPTSADKNLHGDLIDIGLRLRAPGSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSFVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 245 - protein, 502 aa, Vesicular stomatitis virus
KITISFPQSLKGDWRPVPKGYNYCPTSADKNLHGDLIDIGLRLRAPGSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSGVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 246 - protein, 502 aa, Vesicular stomatitis virus
KITISFPQSLKGDWRPVPKGYNYCPTSADKNLHGDLIDIGLRLRAPGSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSQVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 247 - protein, 502 aa, Vesicular stomatitis virus
KITISFPQSLKGDWRPVPKGYNYCPTSADKNLHGDLIDIGLRLRAPQSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSAVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 248 - protein, 502 aa, Vesicular stomatitis virus
KITISFPQSLKGDWRPVPKGYNYCPTSADKNLHGDLIDIGLRLRAPQSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSFVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 249 - protein, 502 aa, Vesicular stomatitis virus
KITISFPQSLKGDWRPVPKGYNYCPTSADKNLHGDLIDIGLRLRAPQSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSGVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 250 - protein, 502 aa, Vesicular stomatitis virus
KITISFPQSLKGDWRPVPKGYNYCPTSADKNLHGDLIDIGLRLRAPQSFKGISADGWMCHAARWITTCDFRWYGPKYITHSIHSFRPSNDQCKEAIRLTNEGNWINPGFPPQSCGYASVTDSESVVVTVTKHQVLVDEYSGSWIDSQFPGGSCTSPICDTVHNSTLWHADHTLDSICDQEFVAMDAVLFTESGKFEEFGKPNSGIRSNYFPYESLKDVCQMDFCKRKGFKLPSGVWFEIEDAEKSHKAQVELKIKRCPHGAVISAPNQNAADINLIMDVERILDYSLCQATWSKIQNKEALTPIDISYLGPKNPGPGPAFTIINGTLHYFNTRYIRVDIAGPVTKEITGFVSGTSTSQVLWDQWFPYGENSIGPNGLLKTASGYKYPLFMVGTGVLDADIHKLGEATVIEHPHAKEAQKVVDDSEVIFFGDTGVSKNPVEVVEGWFSGWRSSLMSIFGIILLIVCLVLIVRILIALKYCCVRHKKRTIYKEDLEMGRIPRRA

SEQ ID NO: 251 - protein, 494 aa, Vesicular stomatitis virus
KFTIVFPQSQKGDWKDVPPNYRYCPSSADQNWHGDLLGVNIRAKMPAVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 252 - protein, 494 aa, Vesicular stomatitis virus
KFTIVFPQSQKGDWKDVPPNYRYCPSSADQNWHGDLLGVNIRAKMPFVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 253 - protein, 494 aa, Vesicular stomatitis virus
KFTIVFPQSQKGDWKDVPPNYRYCPSSADQNWHGDLLGVNIRAKMPGVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 254 - protein, 494 aa, Vesicular stomatitis virus
KFTIVFPQSQKGDWKDVPPNYRYCPSSADQNWHGDLLGVNIRAKMPQVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKRELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 255 - protein, 494 aa, Vesicular stomatitis virus
KFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKAELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 256 - protein, 494 aa, Vesicular stomatitis virus
KFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKFELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 257 - protein, 494 aa, Vesicular stomatitis virus
KFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKGELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 258 - protein, 494 aa, Vesicular stomatitis virus
KFTIVFPQSQKGDWKDVPPNYRYCPSSADQNWHGDLLGVNIRAKMPKVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKQELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 259 - protein, 494 aa, Vesicular stomatitis virus
KFTIVFPQSQKGDWKDVPPNYRYCPSSADQNWHGDLLGVNIRAKMPAVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKAELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 260 - protein, 494 aa, Vesicular stomatitis virus
KFTIVFPQSQKGDWKDVPPNYRYCPSSADQNWHGDLLGVNIRAKMPAVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKFELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 261 - protein, 494 aa, Vesicular stomatitis virus
KFTIVFPQSQKGDWKDVPPNYRYCPSSADQNWHGDLLGVNIRAKMPAVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKGELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 262 - protein, 494 aa, Vesicular stomatitis virus
KFTIVFPQSQKGDWKDVPPNYRYCPSSADQNWHGDLLGVNIRAKMPAVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKQELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 263 - protein, 494 aa, Vesicular stomatitis virus
KFTIVFPQSQKGDWKDVPPNYRYCPSSADQNWHGDLLGVNIRAKMPFVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKAELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 264 - protein, 494 aa, Vesicular stomatitis virus
KFTIVFPQSQKGDWKDVPPNYRYCPSSADQNWHGDLLGVNIRAKMPFVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKFELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 265 - protein, 494 aa, Vesicular stomatitis virus
KFTIVFPQSQKGDWKDVPPNYRYCPSSADQNWHGDLLGVNIRAKMPFVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKGELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 266 - protein, 494 aa, Vesicular stomatitis virus
KFTIVFPQSQKGDWKDVPPNYRYCPSSADQNWHGDLLGVNIRAKMPFVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKQELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 267 - protein, 494 aa, Vesicular stomatitis virus
KFTIVFPQSQKGDWKDVPPNYRYCPSSADQNWHGDLLGVNIRAKMPGVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKAELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 268 - protein, 494 aa, Vesicular stomatitis virus
KFTIVFPQSQKGDWKDVPPNYRYCPSSADQNWHGDLLGVNIRAKMPGVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKFELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 269 - protein, 494 aa, Vesicular stomatitis virus
KFTIVFPQSQKGDWKDVPPNYRYCPSSADQNWHGDLLGVNIRAKMPGVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKGELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 270 - protein, 494 aa, Vesicular stomatitis virus
KFTIVFPQSQKGDWKDVPPNYRYCPSSADQNWHGDLLGVNIRAKMPGVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKQELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 271 - protein, 494 aa, Vesicular stomatitis virus
KFTIVFPQSQKGDWKDVPPNYRYCPSSADQNWHGDLLGVNIRAKMPQVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKAELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 272 - protein, 494 aa, Vesicular stomatitis virus
KFTIVFPQSQKGDWKDVPPNYRYCPSSADQNWHGDLLGVNIRAKMPQVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKFELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 273 - protein, 494 aa, Vesicular stomatitis virus
KFTIVFPQSQKGDWKDVPPNYRYCPSSADQNWHGDLLGVNIRAKMPQVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKGELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 274 - protein, 494 aa, Vesicular stomatitis virus
KFTIVFPQSQKGDWKDVPPNYRYCPSSADQNWHGDLLGVNIRAKMPQVHKAIKADGWMCHAAKWVTTCDYRWYGPQYITHSIHSFIPTKAQCEESIKQTKEGVWINPGFPPKNCGYASVSDAESIIVQATAHSVMIDEYSGDWLDSQFPTGRCTGSTCETIHNSTLWYADYQVTGLCDSALVSTEVTFYSEDGLMTSIGRQNTGYRSNYFPYEKGAAACRMKYCTHEGIRLPSGVWFEMVDKELLESVQMPECPAGLTISAPTQTSVDVSLILDVERMLDYSLCQETWSKVHSGLPISPVDLGYIAPKNPGAGPAFTIVNGTLKYFDTRYLRIDIEGPVLKKMTGKVSGTPTKQELWTEWFPYDDVEIGPNGVLKTPEGYKFPLYMIGHGLLDSDLQKTSQAEVFHHPQIAEAVQKLPDDETLFFGDTGISKNPVEVIEGWFSNWRSSVMAIVFAILLLVITVLMVRLCVAFRHFCCQKRHKIYNDLEMNQLRR

SEQ ID NO: 275 - protein, 495 aa, Vesicular stomatitis virus
KFSIVFPQSQKGNWKNVPSSYHYCPSSSDQNWHNDLLGITMKVKMPATHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 276 - protein, 495 aa, Vesicular stomatitis virus
KFSIVFPQSQKGNWKNVPSSYHYCPSSSDQNWHNDLLGITMKVKMPFTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 277 - protein, 495 aa, Vesicular stomatitis virus
KFSIVFPQSQKGNWKNVPSSYHYCPSSSDQNWHNDLLGITMKVKMPGTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 278 - protein, 495 aa, Vesicular stomatitis virus
KFSIVFPQSQKGNWKNVPSSYHYCPSSSDQNWHNDLLGITMKVKMPQTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTERELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 279 - protein, 495 aa, Vesicular stomatitis virus
KFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEAELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 280 - protein, 495 aa, Vesicular stomatitis virus
KFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEFELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 281 - protein, 495 aa, Vesicular stomatitis virus
KFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEGELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 282 - protein, 495 aa, Vesicular stomatitis virus
KFSIVFPQSQKGNWKNVPSSYHYCPSSSDQNWHNDLLGITMKVKMPKTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEQELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 283 - protein, 495 aa, Vesicular stomatitis virus
KFSIVFPQSQKGNWKNVPSSYHYCPSSSDQNWHNDLLGITMKVKMPATHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEAELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 284 - protein, 495 aa, Vesicular stomatitis virus
KFSIVFPQSQKGNWKNVPSSYHYCPSSSDQNWHNDLLGITMKVKMPATHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEFELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 285 - protein, 495 aa, Vesicular stomatitis virus
KFSIVFPQSQKGNWKNVPSSYHYCPSSSDQNWHNDLLGITMKVKMPATHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEGELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 286 - protein, 495 aa, Vesicular stomatitis virus
KFSIVFPQSQKGNWKNVPSSYHYCPSSSDQNWHNDLLGITMKVKMPATHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEQELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 287 - protein, 495 aa, Vesicular stomatitis virus
KFSIVFPQSQKGNWKNVPSSYHYCPSSSDQNWHNDLLGITMKVKMPFTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEAELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 288 - protein, 495 aa, Vesicular stomatitis virus
KFSIVFPQSQKGNWKNVPSSYHYCPSSSDQNWHNDLLGITMKVKMPFTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEFELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 289 - protein, 495 aa, Vesicular stomatitis virus
KFSIVFPQSQKGNWKNVPSSYHYCPSSSDQNWHNDLLGITMKVKMPFTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEGELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 290 - protein, 495 aa, Vesicular stomatitis virus
KFSIVFPQSQKGNWKNVPSSYHYCPSSSDQNWHNDLLGITMKVKMPFTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEQELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 291 - protein, 495 aa, Vesicular stomatitis virus
KFSIVFPQSQKGNWKNVPSSYHYCPSSSDQNWHNDLLGITMKVKMPGTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEAELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 292 - protein, 495 aa, Vesicular stomatitis virus
KFSIVFPQSQKGNWKNVPSSYHYCPSSSDQNWHNDLLGITMKVKMPGTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEFELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 293 - protein, 495 aa, Vesicular stomatitis virus
KFSIVFPQSQKGNWKNVPSSYHYCPSSSDQNWHNDLLGITMKVKMPGTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEGELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 294 - protein, 495 aa, Vesicular stomatitis virus
KFSIVFPQSQKGNWKNVPSSYHYCPSSSDQNWHNDLLGITMKVKMPGTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEQELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 295 - protein, 495 aa, Vesicular stomatitis virus
KFSIVFPQSQKGNWKNVPSSYHYCPSSSDQNWHNDLLGITMKVKMPQTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEAELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 296 - protein, 495 aa, Vesicular stomatitis virus
KFSIVFPQSQKGNWKNVPSSYHYCPSSSDQNWHNDLLGITMKVKMPQTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEFELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 297 - protein, 495 aa, Vesicular stomatitis virus
KFSIVFPQSQKGNWKNVPSSYHYCPSSSDQNWHNDLLGITMKVKMPQTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEGELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 298 - protein, 495 aa, Vesicular stomatitis virus
KFSIVFPQSQKGNWKNVPSSYHYCPSSSDQNWHNDLLGITMKVKMPQTHKAIQADGWMCHAAKWITTCDFRWYGPKYITHSIHSIQPTSEQCKESIKQTKQGTWMSPGFPPQNCGYATVTDSVAVVVQATPHHVLVDEYTGEWIDSQFPNGKCETEECETVHNSTVWYSDYKVTGLCDATLVDTEITFFSEDGKKESIGKPNTGYRSNYFAYEKGDKVCKMNYCKHAGVRLPSGVWFEFVDQDVYAAAKLPECPVGATISAPTQTSVDVSLILDVERILDYSLCQETWSKIRSKQPVSPVDLSYLAPKNPGTGPAFTIINGTLKYFETRYIRIDIDNPIISKMVGKISGSQTEQELWTEWFPYEGVEIGPNGILKTPTGYKFPLFMIGHGMLDSDLHKTSQAEVFEHPHLAEAPKQLPEEETLFFGDTGISKNPVELIEGWFSSWKSTVVTFFFAIGVFILLYVVARIVIAVRYRYQGSNNKRIYNDIEMSRFRK

SEQ ID NO: 299 - protein, 496 aa, Vesicular stomatitis virus
KFTIVFPHNQKGNWKNVPANYQYCPSSSDLNWHNGLIGTSLQVKMPASHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 300 - protein, 496 aa, Vesicular stomatitis virus
KFTIVFPHNQKGNWKNVPANYQYCPSSSDLNWHNGLIGTSLQVKMPFSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 301 - protein, 496 aa, Vesicular stomatitis virus
KFTIVFPHNQKGNWKNVPANYQYCPSSSDLNWHNGLIGTSLQVKMPGSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 302 - protein, 496 aa, Vesicular stomatitis virus
KFTIVFPHNQKGNWKNVPANYQYCPSSSDLNWHNGLIGTSLQVKMPQSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTERELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 303 - protein, 496 aa, Vesicular stomatitis virus
KFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEAELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 304 - protein, 496 aa, Vesicular stomatitis virus
KFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEFELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 305 - protein, 496 aa, Vesicular stomatitis virus
KFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEGELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 306 - protein, 496 aa, Vesicular stomatitis virus
KFTIVFPHNQKGNWKNVPANYQYCPSSSDLNWHNGLIGTSLQVKMPKSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEQELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 307 - protein, 496 aa, Vesicular stomatitis virus
KFTIVFPHNQKGNWKNVPANYQYCPSSSDLNWHNGLIGTSLQVKMPASHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEAELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 308 - protein, 496 aa, Vesicular stomatitis virus
KFTIVFPHNQKGNWKNVPANYQYCPSSSDLNWHNGLIGTSLQVKMPASHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEFELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 309 - protein, 496 aa, Vesicular stomatitis virus
KFTIVFPHNQKGNWKNVPANYQYCPSSSDLNWHNGLIGTSLQVKMPASHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEGELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 310 - protein, 496 aa, Vesicular stomatitis virus
KFTIVFPHNQKGNWKNVPANYQYCPSSSDLNWHNGLIGTSLQVKMPASHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEQELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 311 - protein, 496 aa, Vesicular stomatitis virus
KFTIVFPHNQKGNWKNVPANYQYCPSSSDLNWHNGLIGTSLQVKMPFSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEAELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 312 - protein, 496 aa, Vesicular stomatitis virus
KFTIVFPHNQKGNWKNVPANYQYCPSSSDLNWHNGLIGTSLQVKMPFSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEFELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 313 - protein, 496 aa, Vesicular stomatitis virus
KFTIVFPHNQKGNWKNVPANYQYCPSSSDLNWHNGLIGTSLQVKMPFSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEGELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 314 - protein, 496 aa, Vesicular stomatitis virus
KFTIVFPHNQKGNWKNVPANYQYCPSSSDLNWHNGLIGTSLQVKMPFSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEQELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 315 - protein, 496 aa, Vesicular stomatitis virus
KFTIVFPHNQKGNWKNVPANYQYCPSSSDLNWHNGLIGTSLQVKMPGSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEAELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 316 - protein, 496 aa, Vesicular stomatitis virus
KFTIVFPHNQKGNWKNVPANYQYCPSSSDLNWHNGLIGTSLQVKMPGSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEFELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 317 - protein, 496 aa, Vesicular stomatitis virus
KFTIVFPHNQKGNWKNVPANYQYCPSSSDLNWHNGLIGTSLQVKMPGSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEGELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 318 - protein, 496 aa, Vesicular stomatitis virus
KFTIVFPHNQKGNWKNVPANYQYCPSSSDLNWHNGLIGTSLQVKMPGSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEQELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 319 - protein, 496 aa, Vesicular stomatitis virus
KFTIVFPHNQKGNWKNVPANYQYCPSSSDLNWHNGLIGTSLQVKMPQSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEAELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 320 - protein, 496 aa, Vesicular stomatitis virus
KFTIVFPHNQKGNWKNVPANYQYCPSSSDLNWHNGLIGTSLQVKMPQSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEFELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 321 - protein, 496 aa, Vesicular stomatitis virus
KFTIVFPHNQKGNWKNVPANYQYCPSSSDLNWHNGLIGTSLQVKMPQSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEGELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 322 - protein, 496 aa, Vesicular stomatitis virus
KFTIVFPHNQKGNWKNVPANYQYCPSSSDLNWHNGLIGTSLQVKMPQSHKAIQADGWMCHAAKWVTTCDFRWYGPKYVTHSIKSMIPTVDQCKESIAQTKQGTWLNPGFPPQSCGYASVTDAEAVIVKATPHQVLVDEYTGEWVDSQFPTGKCNKDICPTVHNSTTWHSDYKVTGLCDANLISMDITFFSEDGKLTSLGKEGTGFRSNYFAYENGDKACRMQYCKHWGVRLPSGVWFEMADKDIYNDAKFPDCPEGSSIAAPSQTSVDVSLIQDVERILDYSLCQETWSKIRAHLPISPVDLSYLSPKNPGTGPAFTIINGTLKYFETRYIRVDIAGPIIPQMRGVISGTTTEQELWTDWYPYEDVEIGPNGVLKTATGYKFPLYMIGHGMLDSDLHISSKAQVFEHPHIQDAASQLPDDETLFFGDTGLSKNPIELVEGWFSGWKSTIASFFFIIGLVIGLYLVLRIGIALCIKCRVQEKRPKIYTDVEMNRLDR

SEQ ID NO: 323 - DNA, 32 bp, Artificial Sequence
  CR2 of human LDL-R
  misc_feature (15)..(15): n is a, c, g, or t
  misc_feature (27)..(27): n is a, c, g, or t
svtcksgdscggrvnrcwrcdgvdcdngsdgc

SEQ ID NO: 324 - protein, 39 aa, Artificial Sequence
  CR3 of human LDL-R
PKTCSQDEFRCHDGKCISRQFVCDSDRDCLDGSDEASCP

SEQ ID NO: 325 - protein, 42 aa, Artificial Sequence
  CR1 of human LDL-R
VGDRCERNEFQCQDGKCISYKWVCDGSAECQDGSDESQETCL

SEQ ID NO: 326 - protein, 41 aa, Artificial Sequence
  CR2 of human LDL-R
SVTCKSGDFSCGGRVNRCIPQFWRCDGQVDCDNGSDEQGCP

SEQ ID NO: 327 - protein, 39 aa, Artificial Sequence; identical to SEQ ID NO: 324
  CR3 of human LDL-R

SEQ ID NO: 328 - protein, 41 aa, Artificial Sequence
  CR4 of human LDL-R
VLTCGPASFQCNSSTCIPKLWACDNDPDCEDGSDEWPQRCR

SEQ ID NO: 329 - protein, 40 aa, Artificial Sequence
  CR5 of human LDL-R
DSSPCSAFEFHCLSGECIHSSWRCDGGPDCKDKSDEENCA

SEQ ID NO: 330 - protein, 39 aa, Artificial Sequence
  CR6 of human LDL-R
VATCRPDEFQCSDGNCIHGSRQCDREYDCKDMSDEVGCV

SEQ ID NO: 331 - protein, 41 aa, Artificial Sequence
  CR7 of human LDL-R
VTLCEGPNKFKCHSGECITLDKVCNMARDCRDWSDEPIKEC

SEQ ID NO: 332 - DNA, 41 bp, Artificial Sequence
  primer sense
tctcatcattttggcaaagatgaagtgccttttgtacttag

SEQ ID NO: 333 - DNA, 36 bp, Artificial Sequence
  primer antisense1
ttgctcaccatgcaattcaccccaatgaataaaaag

SEQ ID NO: 334 - DNA, 31 bp, Artificial Sequence
  primer antisense351
gctcaccatagttccactgatcattccgacc

SEQ ID NO: 335 - DNA, 31 bp, Artificial Sequence
  primer sense
cattggggtgaattgcatggtgagcaagggc

SEQ ID NO: 336 - DNA, 31 bp, Artificial Sequence
  primer sense
aatgatcagtggaactatggtgagcaagggc

SEQ ID NO: 337 - DNA, 31 bp, Artificial Sequence; identical to SEQ ID NO: 335
  primer antisense1

SEQ ID NO: 338 - DNA, 32 bp, Artificial Sequence
  primer antisense351
gttccctttctgtggtcttgtacagctcgtcc

SEQ ID NO: 339 - DNA, 37 bp, Artificial Sequence
  primer sense1
gagctgtacaagaagttcaccatagtttttccacaca

SEQ ID NO: 340 - DNA, 28 bp, Artificial Sequence
  primer sense351
ctgtacaagaccacagaaagggaactgt

SEQ ID NO: 341 - DNA, 34 bp, Artificial Sequence
  primer antisense
ccgcccgggagctcgttactttccaagtcggttc

The invention claimed is:

1. An isolated non-naturally occurring protein comprising an amino acid sequence at least 90% identical to the amino acid sequence set forth in SEQ ID NO: 1 or a homolog thereof, wherein the homolog thereof comprises an amino acid sequence set forth in any one of SEQ ID NOs: 3, 5, 7, 9, 11, and 13,
    wherein the protein comprises an amino acid substitution at one or more of positions 47 and 354 of SEQ ID NO: 1, or at one or more position(s) equivalent to positions 47 and 354 of SEQ ID NO: 1 in any one of SEQ ID NOs: 3, 5, 7, 9, 11, and 13, and
    wherein the protein retains the ability to induce membrane fusion and does not interact with LDL membrane receptor.

2. The isolated non-naturally occurring protein according to claim 1, wherein the protein comprises one of the following amino acid sequences:
    SEQ ID NOs: 15-17;
    SEQ ID NOs: 21-23;
    SEQ ID NOs: 27-29;
    SEQ ID NOs: 33-35;
    SEQ ID NOs: 39-41;
    SEQ ID NOs: 45-47; and
    SEQ ID NOs: 51-53.

3. The isolated non-naturally occurring protein according to claim 1, wherein the amino acid at position 47 or at position 354, or at both positions 47 and 354 of SEQ ID NO: 1 or at equivalent position(s) of the homolog thereof is substituted by an amino acid selected from the group consisting of A, G, F and Q.

4. The isolated non-naturally occurring protein according to claim 1, comprising amino acid substitutions at positions 47 and 354 of SEQ ID NO: 1 or at equivalent position(s) of the homolog thereof.

5. The isolated non-naturally occurring protein according to claim 1, further comprising an amino acid substitution at position 8 and/or at position 209 of SEQ ID NO: 1 or at equivalent position(s) of the homolog thereof.

6. The isolated non-naturally occurring protein according to claim 1, further comprising an amino acid substitution at position 8 of SEQ ID NO: 1 or at equivalent position of the homolog thereof substituted by any amino acid except Q or Y.

7. The isolated non-naturally occurring protein according to claim 1, further comprising an amino acid substitution at position 209 of SEQ ID NO: 1 or at equivalent position of the homolog thereof substituted by any amino acid except H.

8. The isolated non-naturally occurring protein according to claim 1, wherein said protein comprises any one of the amino acid sequences set forth in SEQ ID NOs: 57-154.

9. The isolated non-naturally occurring protein according to claim 1, further comprising an insertion of a heterologous peptide at position 1 or between the amino acids at positions 351 and 352 of SEQ ID NO: 1 or at equivalent position(s) of the homologous protein thereof, wherein the heterologous peptide comprises a part of a ligand or a nanobody that binds a membrane protein expressed on a target cell.

10. The isolated non-naturally occurring protein according to claim 9, wherein the heterologous peptide is at least a part of a ligand that binds a cellular receptor expressed on a target cell.

11. A nucleic acid molecule encoding the isolated non-naturally occurring protein of claim 1.

12. A recombinant virus expressing the isolated non-naturally occurring protein of claim 1.

13. A recombinant virus comprising the nucleic acid molecule of claim 11.

14. A eukaryotic cell containing or expressing the non-naturally occurring protein of claim 1, or containing the nucleic acid molecule of claim 11, or infected by the recombinant virus of claim 12.

15. The isolated non-naturally occurring protein according to claim 9, wherein the heterologous peptide comprises an anti-HER2 nanobody, an anti-MUC18 nanobody, or an anti-PD1 nanobody.

* * * * *